(12) United States Patent
Sims et al.

(10) Patent No.: US 11,788,120 B2
(45) Date of Patent: Oct. 17, 2023

(54) RNA PRINTING AND SEQUENCING DEVICES, METHODS, AND SYSTEMS

(71) Applicant: The Trustees of Columbia University in the City of New York, New York, NY (US)

(72) Inventors: Peter A. Sims, Ardsley, NY (US); Sayantan Bose, Collegeville, PA (US); Jinzhou Yuan, Edgewater, NJ (US)

(73) Assignee: The Trustees of Columbia University in the City of New York, New York, NY (US)

( * ) Notice: Subject to any disclaimer, the term of this patent is extended or adjusted under 35 U.S.C. 154(b) by 419 days.

(21) Appl. No.: 16/766,928

(22) PCT Filed: Nov. 27, 2018

(86) PCT No.: PCT/US2018/062650
§ 371 (c)(1),
(2) Date: May 26, 2020

(87) PCT Pub. No.: WO2019/104337
PCT Pub. Date: May 31, 2019

(65) Prior Publication Data
US 2021/0254143 A1    Aug. 19, 2021

Related U.S. Application Data

(60) Provisional application No. 62/590,889, filed on Nov. 27, 2017.

(51) Int. Cl.
*C12Q 1/6834* (2018.01)
*C12Q 1/686* (2018.01)
*C12Q 1/6869* (2018.01)
*B01L 3/00* (2006.01)

(52) U.S. Cl.
CPC .......... *C12Q 1/6834* (2013.01); *B01L 3/5027* (2013.01); *B01L 2300/0829* (2013.01); *C12Q 1/686* (2013.01); *C12Q 1/6869* (2013.01)

(58) Field of Classification Search
CPC .... C12Q 1/6834; C12Q 1/686; C12Q 1/6869; B01L 3/5027; B01L 2300/0829
See application file for complete search history.

(56) References Cited

U.S. PATENT DOCUMENTS

| | | | |
|---|---|---|---|
| 8,835,358 B2 | 9/2014 | Fodor et al. | |
| 9,174,216 B2 | 11/2015 | Handique et al. | |
| 9,290,808 B2 | 3/2016 | Fodor et al. | |
| 9,290,809 B2 | 3/2016 | Fodor et al. | |
| 9,315,857 B2 | 4/2016 | Fu et al. | |
| 9,708,659 B2 | 7/2017 | Fodor et al. | |
| 9,816,137 B2 | 11/2017 | Fodor et al. | |
| 9,845,502 B2 | 12/2017 | Fodor et al. | |
| 10,155,981 B2 | 12/2018 | Brenner et al. | |
| 10,227,648 B2 | 3/2019 | Hindson et al. | |
| 10,240,197 B1 | 3/2019 | Brenner et al. | |
| 10,273,541 B2 | 4/2019 | Hindson et al. | |
| 10,280,459 B1 | 5/2019 | Brenner et al. | |
| 2003/0108867 A1 | 6/2003 | Chee et al. | |
| 2006/0177833 A1 | 8/2006 | Brenner | |
| 2012/0088691 A1 | 4/2012 | Chen et al. | |
| 2012/0142014 A1 | 6/2012 | Cai | |
| 2014/0031243 A1 | 1/2014 | Cai et al. | |
| 2014/0073520 A1 | 3/2014 | Cai et al. | |
| 2014/0170645 A1 | 6/2014 | Jovanovich et al. | |
| 2014/0206554 A1 | 7/2014 | Hindson et al. | |
| 2015/0329891 A1 | 11/2015 | Tan et al. | |
| 2016/0244825 A1 | 8/2016 | Vigneault et al. | |
| 2017/0081705 A1 | 3/2017 | Davies et al. | |
| 2017/0337459 A1 | 11/2017 | Fodor et al. | |
| 2018/0216160 A1 | 8/2018 | Abate et al. | |
| 2019/0064168 A1 | 2/2019 | Handique et al. | |
| 2019/0085324 A1 | 3/2019 | Regev et al. | |
| 2019/0085412 A1 | 3/2019 | Fan et al. | |
| 2019/0127782 A1 | 5/2019 | Regev et al. | |
| 2019/0345488 A1 | 11/2019 | Soumillon et al. | |

FOREIGN PATENT DOCUMENTS

| WO | 0065094 A2 | 11/2000 |
| WO | 2010138960 A2 | 12/2010 |
| WO | 2011021102 A2 | 2/2011 |
| WO | 2013188872 A1 | 12/2013 |
| WO | 2014089700 A1 | 6/2014 |
| WO | 2014089700 A9 | 9/2014 |
| WO | 2014201273 A1 | 12/2014 |

(Continued)

OTHER PUBLICATIONS

Bose et al., "Scalable microfluidics for single-cell RNA printing and sequencing," Genome Biology, Jun. 6, 2015, vol. 16(120), pp. 1-16.
Cai, "Turning single cells into microarrays by super-resolution barcoding", Briefings In Functional Genomics, Nov. 22, 2012, vol. 12(2), pp. 75-80.
Chen et al., "Spatially resolved, highly multiplexed RNA profiling in single cells," Science, Apr. 24, 2015, vol. 348(6233): aaa6090, pp. 1-36.
Chu et al., "RNA Sequencing: Platform Selection, Experimental Design, and Data Interpretation", Nucleic Acid Therapeutics, Aug. 2012, vol. 22(4), pp. 271-274.
Dey et al., "Integrated genome and transcriptome sequencing of the same cell", Nature Biotechnology, Jan. 19, 2015, vol. 33(3), pp. 285-289.

(Continued)

*Primary Examiner* — Cynthia B Wilder
(74) *Attorney, Agent, or Firm* — CASIMIR JONES, S.C.; Jason R. Bond

(57) ABSTRACT

Described herein are devices, systems, and methods for trapping single-cell lysates in sealed, microwells capable of printing RNA on glass or capturing RNA on beads. These provide efficient, inexpensive manipulation of RNA from individual cells suitable for single-cell transcriptomics on a large scale. Also described are dual barcode capture beads and merged barcode capture beads.

12 Claims, 30 Drawing Sheets

Specification includes a Sequence Listing.

(56) References Cited

FOREIGN PATENT DOCUMENTS

| WO | 2015031691 A1 | 3/2015 |
|---|---|---|
| WO | WO 2015/031691 A1 | 3/2015 |
| WO | 2015044428 A1 | 4/2015 |
| WO | 2015164212 A1 | 10/2015 |
| WO | 2016040476 A1 | 3/2016 |
| WO | WO 2016/040476 A1 | 3/2016 |
| WO | 2016145409 A1 | 9/2016 |
| WO | 2016191533 A1 | 12/2016 |
| WO | 2016207441 A1 | 12/2016 |
| WO | WO 2016/191533 A1 | 12/2016 |
| WO | 2017059094 A2 | 4/2017 |
| WO | 2017087873 A1 | 5/2017 |
| WO | 2017112957 A1 | 6/2017 |
| WO | WO 2017124101 * | 7/2017 |
| WO | 2017164936 A1 | 9/2017 |
| WO | 2019046307 A1 | 3/2019 |
| WO | 2019079399 A1 | 4/2019 |

OTHER PUBLICATIONS

Fan et al., "Combinatorial labeling of single cell for gene expression cytometry," Science, Feb. 6, 2015, vol. 347(6222), pp. 628, 1258367-1-8.

Farmer, "Systems Biology Faculty Nab Chan Zuckerberg Initiative Grants to Advance Human Cell Atlas", Oct. 16, 2017, Columbia University, Department of Systems Biology, Columbia Systems Biology, https://systemsbiology.columbia.edu/news/systems-biology-faculty-nab-chan-zuckerberg-initiative-grants-to-advance-human-cell-atlas.

Fu et al., "Single Cell Total RNA Sequencing through Isothermal Amplification in Picoliter-Droplet Emulsion", Analytical Chemistry, Oct. 26, 2016, vol. 88(22), pp. 10795-10799.

Gierahn et al., "Seq-Well: A Portable, Low-Cost Platform for High-Throughput Single-Cell RNA-Seq of Low-Input Samples", Nature Methods, Apr. 2017, vol. 14(4), pp. 395-398.

Goodarzi et al., "Revealing Global Regulatory Perturbations across Human Cancers", Molecular Cell, Dec. 11, 2009, vol. 36(5), pp. 900-911.

Habib et al., "Div-Seq: Single-nucleus RNA-Seq reveals dynamics of rare adult newborn neurons", Science, Jul. 28, 2016, vol. 353(6302), pp. 1-8.

Hashimshony et al., "CEL-Seq: single-cell RNA-Seq by multiplexed linear amplification", Cell Reports, Sep. 27, 2012, vol. 2(3) pp. 666-673.

Hiroaki, "Systems Biology: A Brief Overview," Science, vol. 295, No. 5560, pp. 1662-1664, Mar. 2002 (Abstract).

International Preliminary Report on Patentability for International Application No. PCT/US2016/034270 dated Dec. 7, 2017.

International Search Report and Written Opinion for International Application No. PCT/US2016/034270 dated Oct. 7, 2016.

International Search Report and Written Opinion for International Application No. PCT/US2018/062650 dated Feb. 13, 2019.

Kimmerling et al., "A microfluidic platform enabling single-cell RNA-seq of multigenerational lineages", Nature Communications, Jan. 6, 2016, vol. 7, pp. 1-7.

Kitano, "Systems Biology: A Brief Overview," Science, Mar. 1, 2002, vol. 295(5560), pp. 1662-1664.

Klein et al., "Droplet Barcoding for Single-Cell Transcriptomics Applied to Embryonic Stem Cells", Cell, May 21, 2015, vol. 161(5), pp. 1187-1201.

Kolodziejczyk et al.,"The technology and biology of single-cell RNA sequencing," Molecular Cell, May 21, 2015, vol. 58(4), pp. 610-620.

Lan et al., "Single-cell genome sequencing at ultra-high-throughput with microfluidic droplet barcoding", Nature Biotechnology, Jul. 2017, vol. 35(7), pp. 640-646 (Abstract).

Liu et al., "Emerging imaging and genomic tools for developmental systems biology," Developmental Cell, Mar. 21, 2016, vol. 36(6), pp. 597-610.

McDonald et al., "Poly(dimethylsiloxane) as a Material for Fabricating Microfluidic Devices", Accounts of Chemical Research, Jul. 2002, vol. 35(7), pp. 491-499.

Meade-Kelly, "Divide and conquer: New single cell approach broadens range of cell types that can be studied in the brain", Jul. 29, 2016, Broad Institute, Broadminded Blog, https://www.broadinstitute.org/blog/divide-and-conquer-new-single-cell-approach-broadens-range-cell-types-can-be-studied-brain.

Men et al., "Digital Polymerase Chain Reaction in an Array of Femtoliter Polydimethylsiloxane Microreactors", Analytical Chemistry, Apr. 7, 2012, vol. 84(10), pp. 4262-4266.

Office Action (Communication Pursuant to Article 94(3) EPC) dated Dec. 9, 2019 for European Application No. 16733232.9.

Shiroguchi et al., "Digital RNA sequencing minimizes sequence-dependent bias and amplification noise with optimized single-molecule barcodes", Proceedings of the National Academy of Sciences, Jan. 24, 2012, vol. 109(4), pp. 1347-1352.

Streets et al., "Microfluidic single-cell whole-transcriptome sequencing," Proceedings of the National Academy of Sciences, May 13, 2014, vol. 111(19), pp. 7048-7053.

Sweedler et al., "Single cell analysis", Analytical and Bioanalytical Chemistry, Jan. 2007, vol. 387(1), pp. 1-2.

Van Der Maaten et al., "Visualizing Data using t-SNE", Journal of Machine Learning Research, Nov. 2008, vol. 9, pp. 2579-2605.

White et al., "High-throughput microfluidic single-cell RT-qPCR", Proceedings of the National Academy of Sciences ol the United States of America, Jun. 17, 2011, vol. 108(34), pp. 13999-14004.

Wu et al., "Quantitative assessment of single-cell RNA-sequencing methods", Nature Methods, Oct. 20, 2013, vol. 11(1), pp. 41-46.

Yuan et al., "An Automated Microwell Platform for Large-Scale Single Cell RNA-Seq", Scientific Reports, Sep. 27, 2016, vol. 6, pp. 1-10.

Zilionis et al., "Single-cell barcoding and sequencing using droplet microfluidics", Nature Protocols, Dec. 8, 2016, vol. 12(1), pp. 44-73.

Gole et al.. Massively parallel polymerase cloning and genome sequencing of single cells using nanoliter microwells. Nature Biotechnology. 2013. vol 31(12), 1126-1132.

Koshkin et al., LNA (locked nucleic acid): an RNA mimic forming exceedingly stable LNA:LNA dkuplexes. Journal of the American Chemical Society, 1998, 120(50):13252-13253.

Mair et al., A Targeted Multi-omic Analysis Approach Measures Protein Expression and Low-Abundance Transcripts on the Single-Cell Level. Cell Reports. 2020. 31, 107499. 20 pages.

Marcus et al., Microfluidic Single-Cell mRNA Isolation and Analysis. Anal. Chem. 2006, 78, 9, 3084-3089.

Marcus et al., Parallel Picoliter RT-PCR Assays Using Microfluidics. Anal. Chem. 2006, 78, 3, 956-958.

Marcus. Single Cell Gene Expression Analysis Using Microfluidics. Thesis, Clifornia Institute of Technology. 2006. 179 pages.

Wang et al., RNA-Seq: a revolutionary tool for transcriptomics. Nat Rev Genet. 2009; 10(1):57-63.

Li et al., "Injection Molded Microfludics for Establishing High-Density Single Cell Arrays in an Open Hydrogel Format," Analytical Chemistry, vol. 92, No. 3, pp. 2794-2801, Jan. 2020.

* cited by examiner

Bright Field Fluorescence After Fluorescence After
 Reverse Transcription RNase Digestion

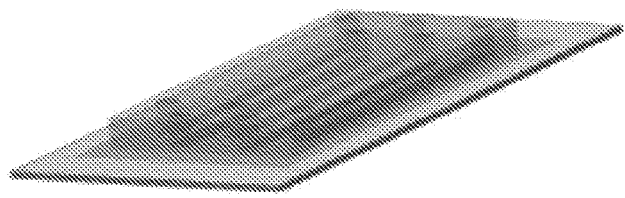
Fig. 5A
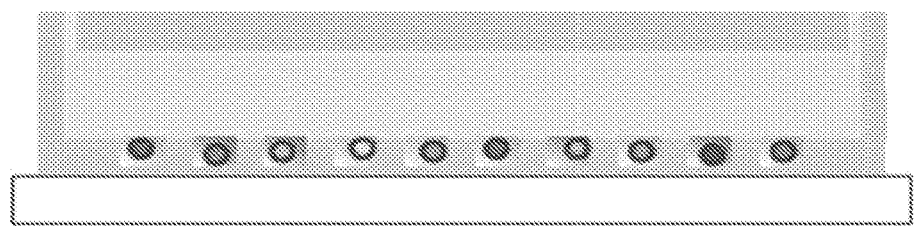
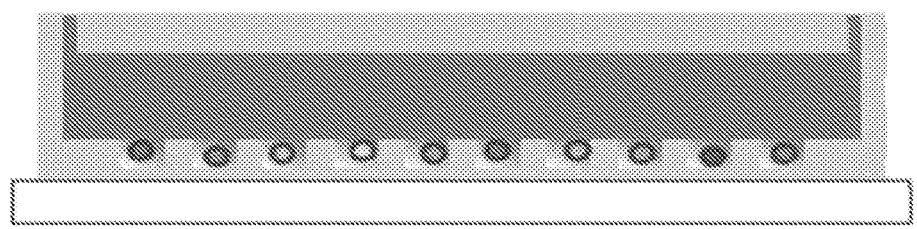
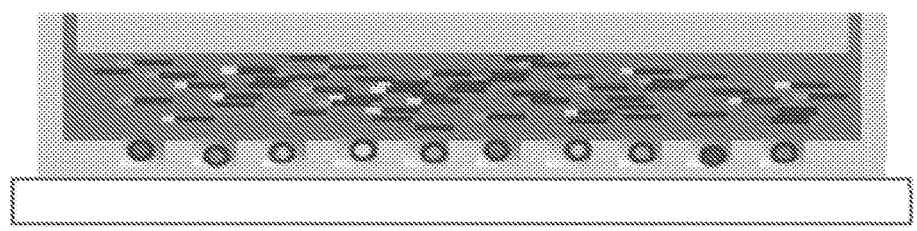
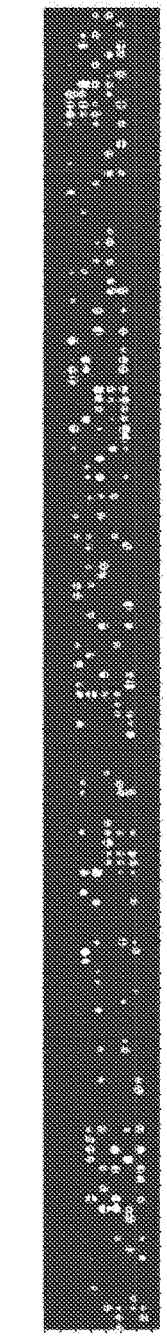
Fig. 5B
Fig. 5C

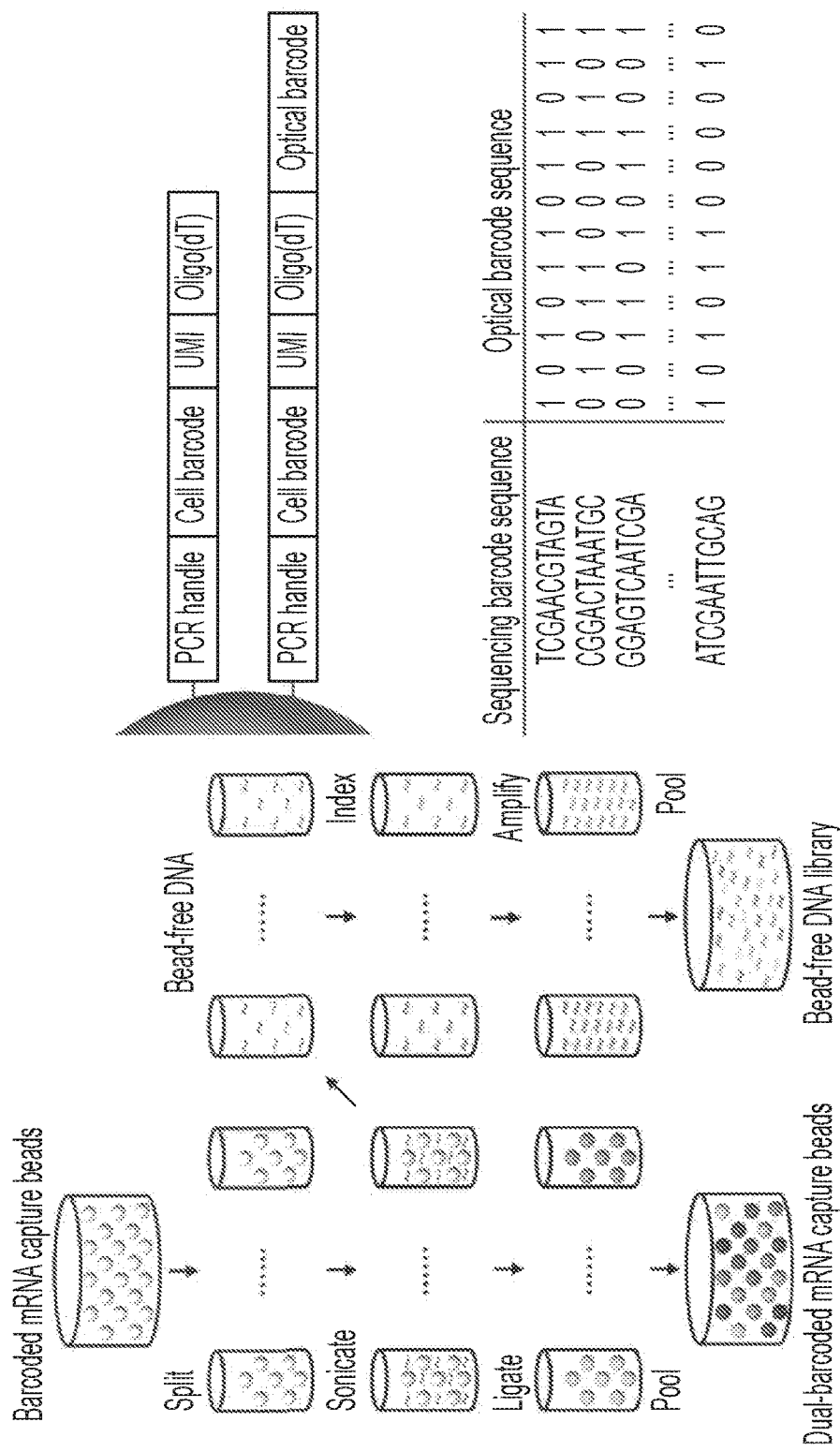
FIG. 15A (left)
FIG. 15B (upper right)
FIG. 15C (lower right)

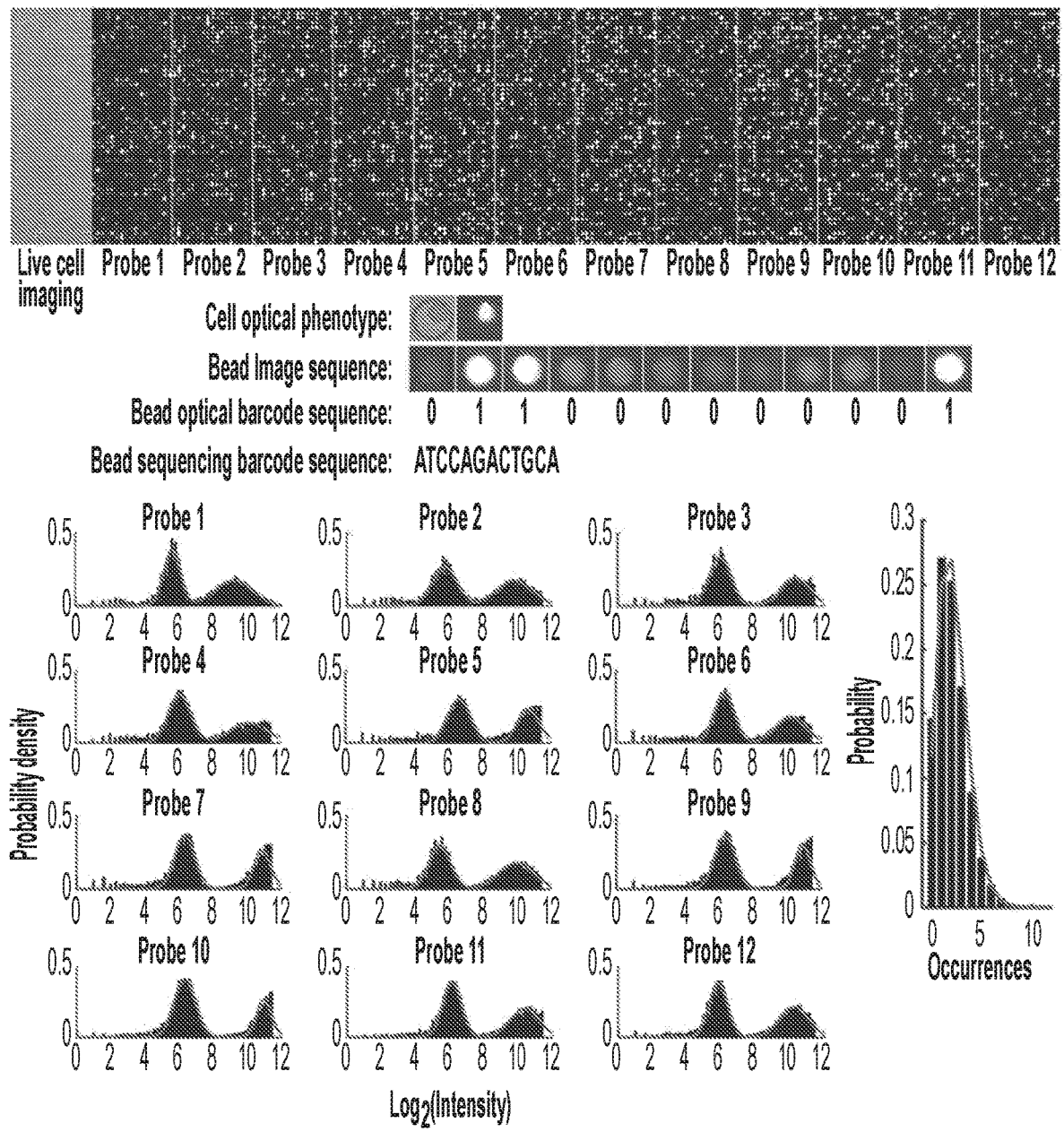
FIG. 16A (top)
FIG. 16B (bottom left)
FIG. 16C (bottom right)

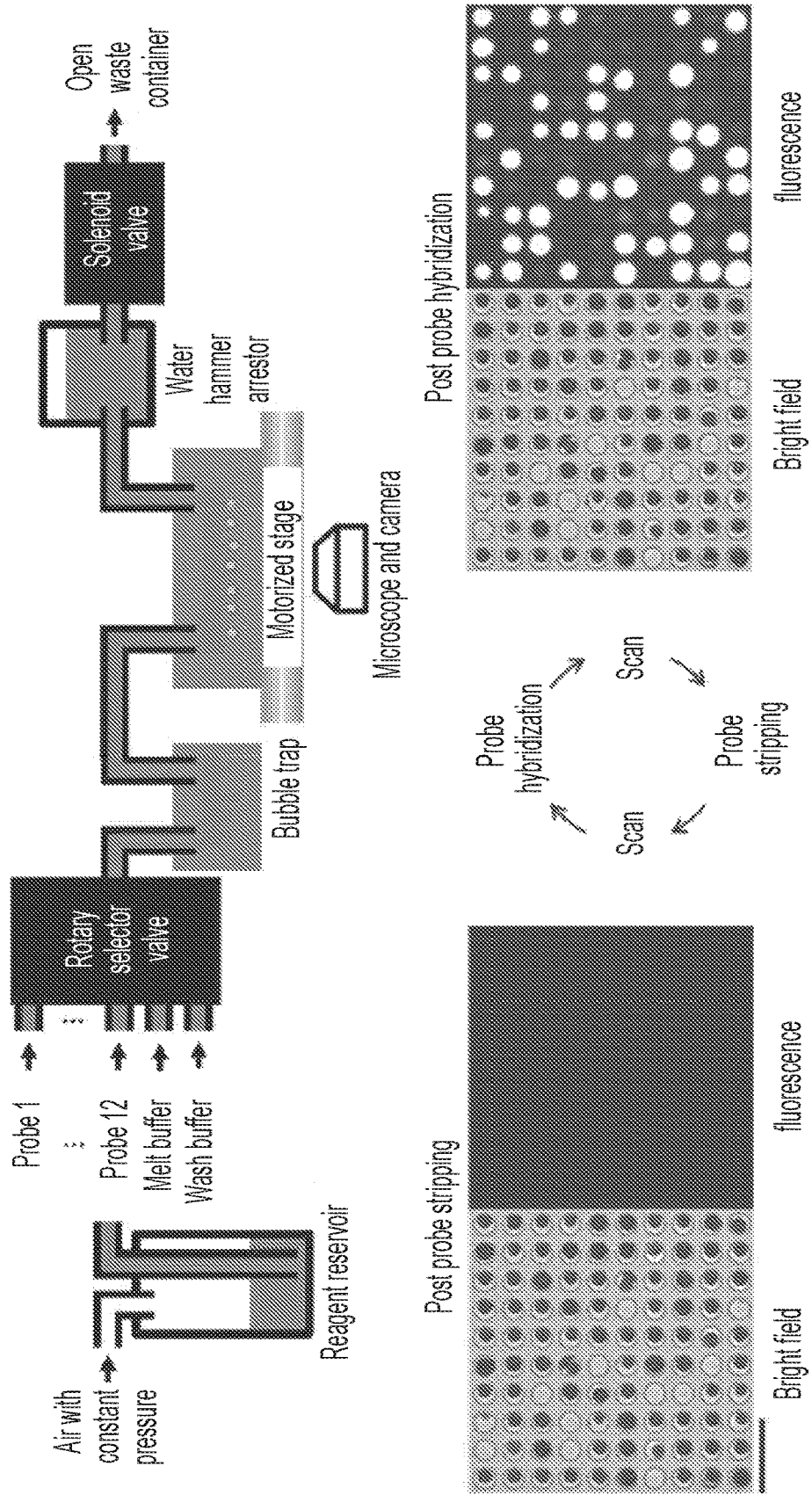
FIG. 17A (top)
FIG. 17B (bottom)

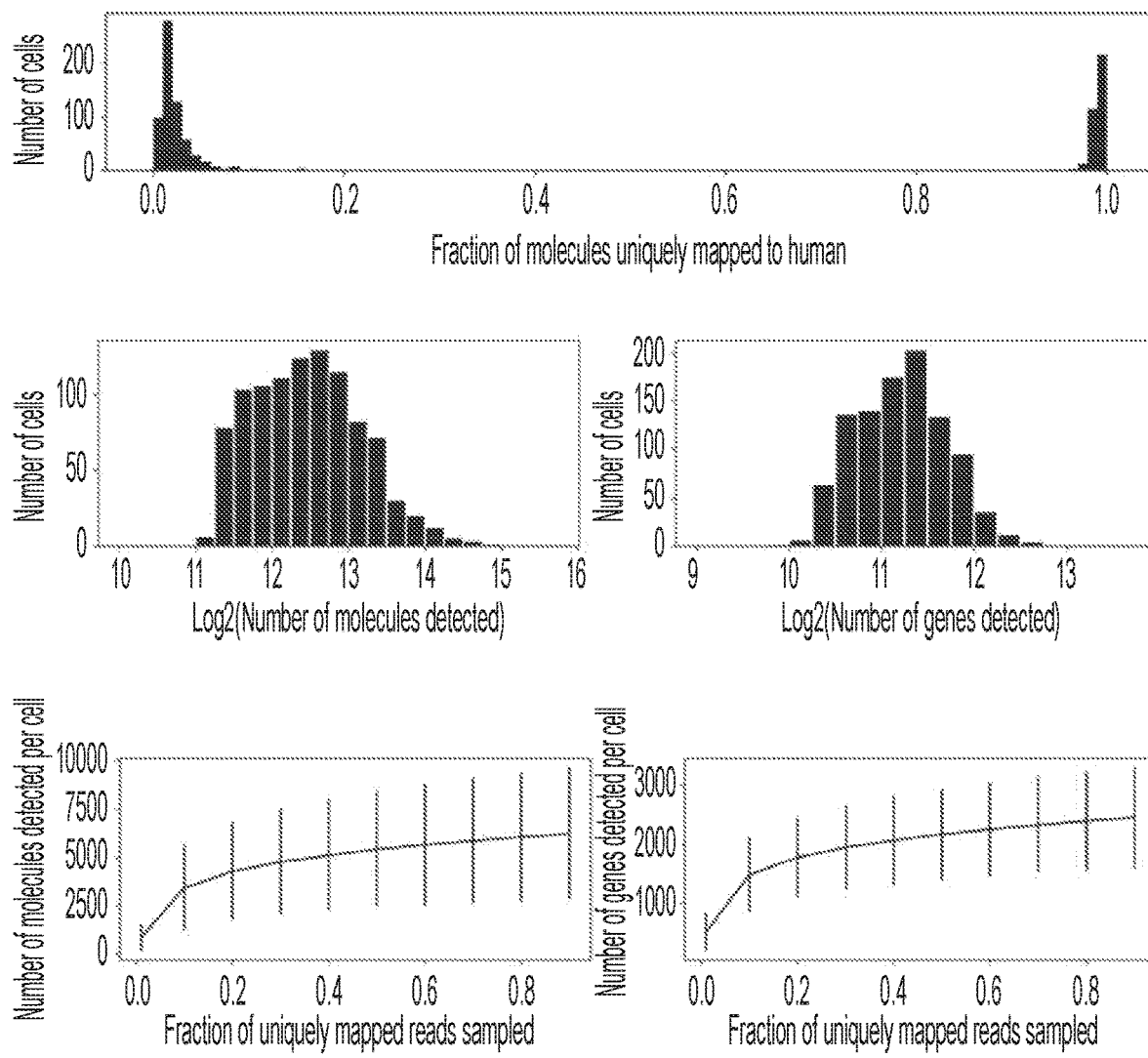
FIG. 18A (top)
FIG. 18B (center left)
FIG. 18C (center right)
FIG. 18D (bottom left)
FIG. 18E (bottom right)

FIG. 20A (top)

FIG. 20B (bottom)

FIG. 21A (top)

FIG. 21B (bottom)

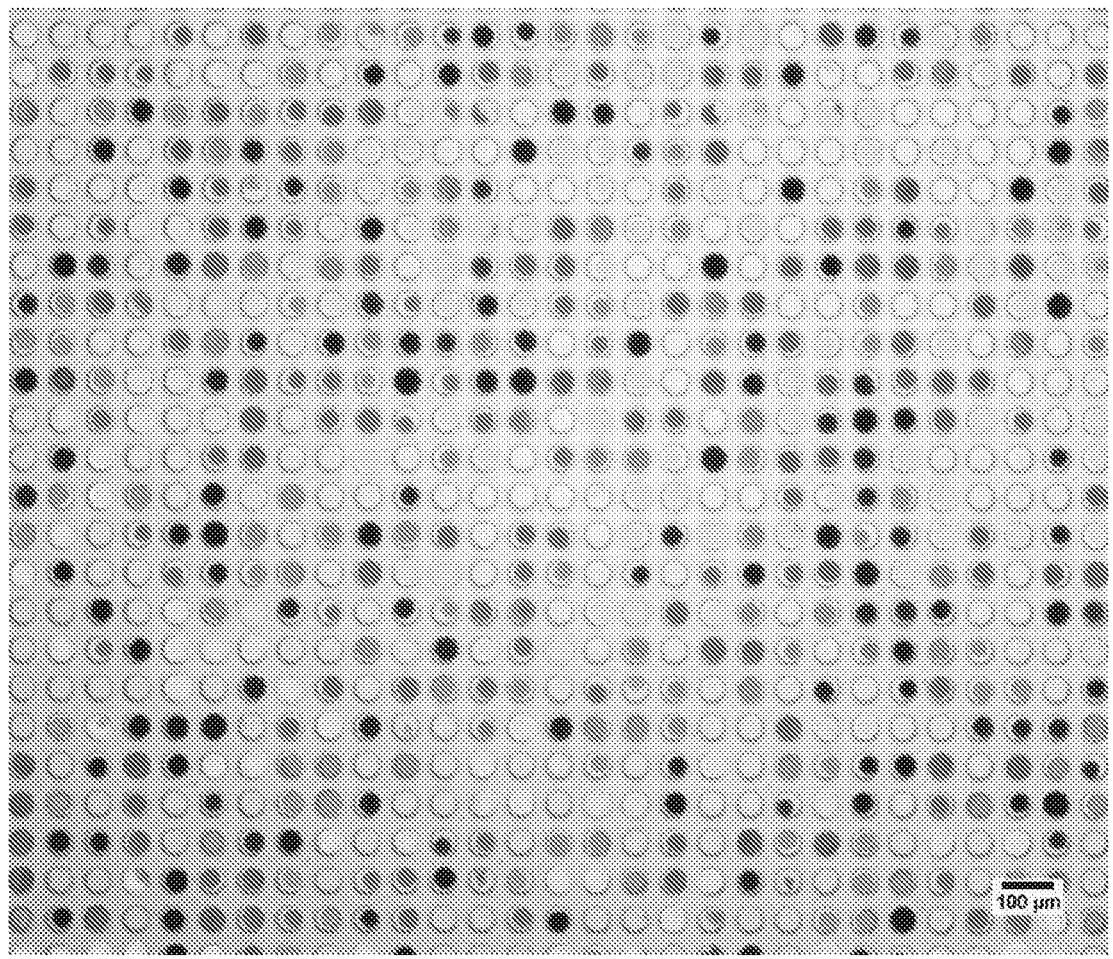
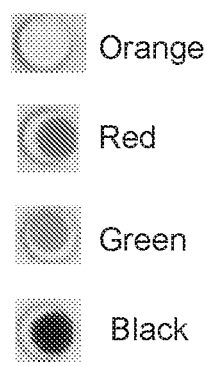
Fig. 26

RNA PRINTING AND SEQUENCING DEVICES, METHODS, AND SYSTEMS

STATEMENT OF GOVERNMENTAL INTEREST

This invention was made with government support under Contract Nos. EB016071 and CA202827 awarded by the National Institutes of Health. The government has certain rights in the invention.

SEQUENCE LISTING

The text of the computer readable sequence listing filed herewith, titled "39989-252_SEQUENCE_LISTING", created Mar. 15, 2023, having a file size of 4,643,474 bytes, is hereby incorporated by reference in its entirety.

BACKGROUND

Single cell analysis is important for understanding how cells respond to drugs and other perturbations because phenotypic responses are asynchronous and cells are often both genetically and epigenetically heterogeneous. In the absence of artificial or external perturbations, the natural processes of cellular differentiation during development and malignant transformation in cancer also occur asynchronously and give rise to phenotypic heterogeneity. While single cell RNA-Seq is emerging as a high-dimensional and increasingly scalable tool for assessing phenotypic heterogeneity, many aspects of cellular phenotype cannot be inferred from the transcriptome alone. However, high-content imaging by microscopy could greatly expand the space of observables in a single cell analysis, particularly if it can be integrated with single cell RNA-Seq. High-content imaging assays using optical microscopy provide access to numerous phenotypic observables for cellular metabolism, protein localization, protein synthesis, cell cycle states, and cell signaling all with single cell resolution. However, existing tools for merging single cell imaging and sequencing are expensive, low-throughput, and incompatible with short-term cell culture and stimulation. The instant disclosure addresses this issue by combining a highly scalable microfluidic platform for single cell RNA-Seq and imaging with associated methodologies that allow for the association of sequence barcodes for inexpensive pooled library preparation with optical barcodes in devices described herein.

SUMMARY

The disclosure allows for devices, systems, and methods relating to genome-wide profiling of RNA from hundreds to thousands of individual cells in parallel for only a few cents per cell. The devices, systems, and methods described herein address the scalability problem of parallel preparation of low-input single cell libraries for RNA sequencing. Devices, systems, and methods described herein allow for parallel RNA profiling of individual cells in a device that is compatible with short term cell culture, drug stimulation experiments, and high-content fluorescence imaging. In an aspect, this is because the cells are physically segregated into microwells but still in sufficiently close proximity to communicate via diffusible factors.

In an aspect, the disclosure provides for a device or system comprising
 (a) one or more mRNA capture beads;
 (b) one or more cell-identifying optical barcodes;
 (c) a plurality of chambers, microchambers, or microwells comprising one or more mRNA capture beads and/or one or more cell-identifying optical barcodes; and
 (d) wherein the plurality of chambers, microchambers, or microwells comprising one or more mRNA capture beads and/or one or more cell-identifying optical barcodes are configured for reversible sealing.

In an aspect, the disclosure provides for a method of drug discovery, drug profiling, and/or drug testing comprising
 (a) combining one or more mRNA capture beads with one or more cell-identifying optical barcodes;
 (b) adding one or more mRNA capture beads with one or more cell-identifying optical barcodes to a plurality of chambers, microchambers, or microwells;
 (c) wherein the plurality of chambers, microchambers, or microwells including one or more mRNA capture beads and one or more cell-identifying barcodes are configured for reversible sealing; and
 (d) adding one or more drugs to the plurality of chambers, microchambers, or microwells configured for reversible sealing; and
 (e) adding one or more cells to the plurality of chambers, microchambers, or microwells that are configured for reversible sealing.

In an aspect, the one or more optical barcodes include one or more optical barcode sequences. In another aspect, the one or more optical barcodes include one or more fluorescent dyes including different colors and/or intensities.

The disclosure further provides for method of drug discovery, drug profiling, and/or drug testing described herein comprising (f) adding a buffer to the plurality of chambers, microchambers, or microwells configured for reversible sealing. In an aspect, the buffer includes a lysis buffer.

The disclosure further provides for a method of drug discovery, drug profiling, and/or drug testing comprising analyzing said cell-identifying optical barcode sequences by fluorescence.

In another aspect, the device or system of described herein comprise a plurality of chambers, microchambers, or microwells attached to a polysiloxane substrate. In yet another aspect, said polysiloxane substrate comprises polydimethylsiloxane.

In another aspect, the device or system described herein comprise cell-identifying optical barcode sequences are adapted for fluorescence detection.

In yet another aspect, the device, system, or methods comprise cells and said cells are not arranged in a droplet configuration.

In another aspect, the disclosure provides for a method for single cell RNA capture and sequencing, wherein said method comprises
 (a) introducing at least one cell into a microwell, wherein the microwell is attached to a first substrate that faces a second substrate and wherein oligo primers are attached to the surface of said second substrate;
 (b) hybridizing mRNA molecules to the surface of said second substrate;
 (c) adding at least one buffer to the microwell; and
 (d) contacting said first substrate with said second substrate, thereby creating a seal between said first substrate and said second substrate.

In yet another aspect, the disclosure provides for a device for single cell RNA capture and sequencing, wherein said device comprises a plurality of microwells; wherein said plurality of microwells are attached to a first polysiloxane substrate; a second substrate comprising glass that faces said first substrate, wherein oligo primers are grafted onto to the glass surface of said second substrate.

The disclosure further provides for a microwell comprising a composition comprising one or more mRNA capture beads; one or more cell-identifying optical barcode sequences; one or more cells, one of more buffers.

In another aspect, the disclosure provides for a plurality of dual barcode oligonucleotide capture beads, each capture bead comprising a first and a second plurality of oligonucleotide sequences separately attached to an outer surface of the capture bead, wherein the first plurality is an oligonucleotide sequence comprising:

(a) a PCR handle attached to each capture bead, wherein the PCR handle is identical in each oligonucleotide sequence on each capture bead;
(b) a first barcode attached to the PCR handle, wherein the first barcode is identical for all oligonucleotide sequences attached to the same capture bead, and wherein the first barcode differs for each capture bead;
(c) a unique molecular identifier (UMI) of length 6 to 16 nucleotides (nt) attached to the barcode, wherein the UMI may differ between oligonucleotide sequences on the capture bead, wherein the UMI may differ between different capture beads; and
(d) an oligo(dT) attached to the UMI;

wherein the second plurality is an oligonucleotide sequence comprising (a), (b), (c), (d) and a second barcode attached to the oligo(dT), wherein the second plurality of oligonucleotide sequences represents 0.1% to 10% of attached oligonucleotide sequences.

In an embodiment, the second barcode is configured to identify a cell associated with the capture bead, and to identify the first barcode. Preferably, the second barcode is configured to be read by fluorescence hybridization.

In an embodiment of the dual barcode bead, the UMI is of length 6 nucleotides (nt) to 10 nt, or the UMI length may be 6 nt. In an embodiment the second barcode is of length 8 nt to 30 nt, or of length 8 nt to 15 nt, or of length 8 nt. Preferably, the dual barcode capture bead is in the form of a plurality of capture beads.

In another embodiment, the disclosure provides for a plurality of merged barcode oligonucleotide capture beads, each capture bead comprising a plurality of oligonucleotide sequences separately attached to an outer surface of the capture bead, wherein each oligonucleotide sequence comprises:

(a) a PCR handle attached to each capture bead, wherein the PCR handle is identical in each oligonucleotide sequence on each capture bead;
(b) a barcode attached to the PCR handle, wherein the barcode is configured for identification of the attached capture bead and associated cell, wherein the barcode comprises N blocks, wherein each block is an oligonucleotide sequence of length 8 nt to 30 nt chosen from one of N sets of M oligonucleotides, wherein N is at least 2 and M is at least 30;
(c) a unique molecular identifier (UMI) of length 6 to 16 nucleotides (nt), wherein the UMI is either (i) attached to the barcode or (ii) segments of the UMI appear before or between or after the blocks of oligonucleotides, wherein the UMI may differ between oligonucleotide sequences on the capture bead, and wherein the UMI may differ between different capture beads; and
(d) an oligo(dT) attached to the UMI.

The variable N represents the number of blocks and an equivalent number of oligonucleotide sets containing M oligonucleotides. The number N of blocks/sets may be up to 4, 6, 8, 10, or more. A set of M oligonucleotides may have up to 200, 300, 400, or more oligonucleotides. In an embodiment of the merged barcode capture bead, N is 2 and M is 96. In another embodiment, the UMI is of length 6 nt to 10 nt, or the UMI is of length 6 nt. In another embodiment, the identification of the attached capture bead is by on-bead sequential fluorescence hybridization or on-bead sequencing.

In another embodiment, the disclosure provides for a method for single cell RNA capture and sequencing, wherein the method comprises (a) introducing into a microwell a cell and an oligonucleotide capture bead, wherein the microwell is formed from a first substrate that faces a second substrate; and (b) adding at least one buffer to the microwell. The first substrate and second substrate may be unitary in structure. In an embodiment, the capture beads are dual barcode or merged barcode capture beads. In another embodiment of this method, the first and/or second substrate is a polysiloxane substrate. In another embodiment the first and/or second substrate is polydimethylsiloxane (PDMS). The method may also include another step (e) analyzing the sealed first substrate and second substrate by microscopy or fluorescence, preferably on-bead microscopy or on-bead fluorescence. Preferably, the buffer comprises a lysis buffer.

In another embodiment, the disclosure provides a device for single cell RNA capture and sequencing, wherein said device comprises (a) a plurality of capture beads, (b) a first substrate comprising a plurality of microwells, and (c) a second substrate that faces said first substrate. In an embodiment of the device, the first and/or second substrates are polysiloxane substrates. In another embodiment, the first and/or second substrates are PDMS substrates. In another embodiment, the capture beads are dual barcode or merged barcode capture beads. In another embodiment of the device, individual capture beads are distributed in individual microwells.

BRIEF DESCRIPTION OF THE FIGURES

(FIG. 2A) For mRNA capture on polymer beads, the microwell array is fabricated in a thin PDMS layer on top of a glass slide or coverslip with a microfluidic flow channel above. Cells are first deposited in the microwell array by gravity followed by beads (while circles) covalently functionalized with oligo(dT) primers (orange circular outlines). A lysis buffer is introduced followed by rapid displacement of fluid in the channel with oil, which conformally seals the array. Single cell lysates (green) become trapped in individual microwells and mRNA hybridizes to the oligo(dT) on the beads (red circular outlines).

As illustrated in FIG. 3A, beads are first attached to a set of barcoded oligonucleotides in a multi-well plate, pooled into a single tube, and then re-distributed into a second multi-well plate for combinatorial addition of a second barcode sequence and capture site (oligo(dT)). FIG. 3B provides for detailed molecular biology for solid-phase, combinatorial barcode synthesis. A first barcode sequence is copied onto a dual-biotinylated oligonucleotide containing the T7 promoter sequence and a partial Illumina adapter using DNA polymerase. The resulting double-stranded DNA is conjugated to streptavidin-coated beads, and the non-biotinylated strand is removed. After pooling and expanding the beads, a second reaction is used to add a second barcode sequence and oligo(dT) by priming off of a universal anchor sequence that follows the first barcode.

As shown in FIG. 4A, cells are first deposited in the microwell array by gravity. The glass surface opposite the microwell array is covalently functionalized with oligo(dT) primers for mRNA capture (orange line). The device is then rapidly and conformally sealed against a glass surface in the presence of lysis buffer, flipped over, and held in a sealed position using negative pressure. Single cell lysates (green) become trapped in the sealed microwells, and mRNA hybridizes to the oligo(dT) primers on the glass surface, resulting in single cell mRNA "prints" (red lines). As shown by FIG. 4B an array of single cell mRNA prints on a glass coverslip generated using the device in FIG. 4A and imaged after on-chip reverse transcription. The double-stranded RNA/DNA hybrids are stained with SYTOX Orange, an intercalator dye and imaged on the glass surface. >96% of the prints result from individual cells. Note that the bright spots in the image that are not registered with the array originate from genomic DNA aggregates that were not fully removed by DNase digestion. FIG. 4C shows close-up images of single cell RNA printing. The left-most panel is a bright field image of three cells in individual microwells of the array, the middle panel is a fluorescence image of the corresponding RNA prints on the glass surface after reverse transcription and staining with SYTOX Orange, and the right-most panel is a fluorescence image of the glass surface after RNase digestion, demonstrating that the fluorescent prints originate from captured RNA.

FIGS. 5A-5C provide for an example flow cell device for single cell RNA-Seq. (A) Graphical representation of our five-lane microwell array flow cell device for single cell RNA-Seq. FIG. 5B shows a schematic of on-chip steps for single cell RNA-Seq. After depositing cells, barcoded capture beads (barcode sequences represented as different colors), and sealing as in FIG. 2A, single cell lysates (green) are trapped in individual microwells and mRNA hybridizes to the barcoded capture beads. The device is unsealed and rapidly washed by flow before on-chip, solid-phase reverse transcription and second-strand synthesis followed by elution and pre-amplification of the pooled library by in vitro transcription. FIG. 5C shows a montage of fluorescence images from part of one lane of the device in FIG. 5A showing beads (red) and cells (blue) loaded in the array. Note that this image was acquired following cell lysis while the device is sealed, and so the blue live stain fills the entire volume of the corresponding microwell and is confined to the microwell by sealing.

FIG. 6A shows a gene body distribution for uniquely mapped reads showing that we are primarily sequencing the 3'-end of transcripts, as expected. FIG. 6B shows a histogram of the number of genes detected per cell for the 396 single cell profiles used in all subsequent analysis of Experiment 1 and 247 single cell profiles used in all subsequent analysis of Experiment 2.

FIG. 7B provides for the same as FIG. 7A, but for single cell profiles in the MCF10a-exlusive lane. As shown in FIG. 7C, differential expression analysis was conducted to obtain cell type-specific gene sets for the U87 and MCF10a cells based on single cell profiles from the pure-cell lanes. Here, we show a histogram of log-ratio of the coefficients of variation (CVs) for the cell type-specific gene sets between the mixed lane profiles and the profiles from the respective pure lanes. As expected, the heterogeneity given by CV is greater for cells in the mixed lanes than in the cell type-exclusive lanes for the cell type-specific genes.

FIG. 8A: iPAGE gene ontology/pathway analysis based on rank-ordering of differentially expressed genes using $+/-(1-p)$ where p is the p-value for differential expression between the U87- and MCF10a-exclusive lanes given by the Wilcoxin rank-sum test. Values are positive for genes more highly expressed in U87 and negative for genes more highly expressed in MCF10a. FIG. 8B: t-SNE clustering of 396 single cell profiles based on the differentially expressed genes color-coated by the lane-of-origin of each profile. Two clear spatial clusters form and each is predominantly associated with a specific cell type-exclusive lane. FIG. 8C shows the same t-SNE clustering shown in (FIG. 8B) but color-coated with a score indicating expression of the U87-specific genes vs. the MCF10a-specific genes. The score is based on the relative rank ordering of U87- and MCF10a-specific genes in each cell.

FIG. 14B shows the intensity distribution for the beads in one of the three fluorescence channels demonstrating our ability to separate the optical barcodes based on fluorescence intensity (in this case with five different intensity levels).

FIG. 15A shows work flow of the synthesis of dual-barcoded mRNA capture beads. FIG. 15B is a schematic illustration of oligo sequence composition on dual-barcoded mRNA capture beads (upper-right). FIG. 15C is a look-up table linking sequencing barcode sequence with optical barcode sequence.

FIG. 16A shows representative images from optical phenotyping of cells and from optical demultiplexing of beads. FIG. 16B is a histogram of bead intensity after each of the 12 rounds of probe hybridization. FIG. 16C is histogram of optical barcode sequence occurrences.

FIG. 17A is an illustration of the design of the automated reagent delivery and imaging system for optical demultiplexing. FIG. 17B illustrates optical demultiplexing work flow. Scale bar: 200 μm.

FIG. 18A is a histogram of the fraction of molecules uniquely aligned to the human transcriptome for a mixed species analysis including human U87 and mouse 3T3 cells. FIG. 18B is a histogram of the number of uniquely aligned molecules per cell. FIG. 18C is a histogram of the genes detected per cell. FIG. 18D is a chart of the number of molecules detected (bottom-left) per cell as a function of the fraction of uniquely aligned reads sampled. FIG. 18E is a chart of the number of genes detected (bottom-right) per cell as a function of the fraction of uniquely aligned reads sampled.

FIG. 26 is a color image produced by merging the monochrome images of the same field of view in bright field, Cy3, and Cy5 channels.

DETAILED DESCRIPTION

Figure 1A:
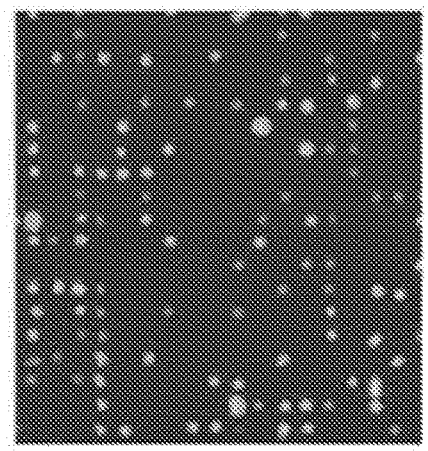
FIG. 1A provides for fluorescence imaging of a microwell array loaded with optically barcoded beads after introduction and hybridization of a single optical barcode probe. The brighter beads contain optical barcode oligonucleotides that are complimentary to the probe.

In an aspect, the disclosure provides for a microwell array system, devices, and methods for pairing individual cells with mRNA capture beads. In another aspect, the disclosure provides for a microwell array system, device, and methods for pairing individual cells with mRNA capture beads that introduce, cell-identifying barcode sequences into cDNA generated after mRNA capture. In an aspect, the system is compatible with high-content cellular imaging and drug stimulation experiments.

The disclosure further provides for capture beads, for example mRNA capture beads, or probes comprising one or more optical barcodes described herein. In an aspect, the capture beads, for example mRNA capture beads, or probes are used to identify drug and/or to be used in drug simulation experiments.

In an aspect, the disclosure provides for devices, systems, and/or methods wherein cells are arranged in a grid and/or a chamber. In yet another aspect, the disclosure provides for devices, systems, and/or methods wherein cells are arranged in a grid and/or chamber as compared to devices, systems, and/or methods wherein cells are arranged in droplets or a configuration where cells are physically segregated from one another. In an aspect, a microfluidic device, system, or method described herein comprises a flow cell with an array of microwells embedded in either the top or bottom of the device. In another aspect, the device described herein is a solid state device that allows for single cell isolation, imaging, and/or uniform parallel introduction of reagents to a plurality of cells.

The disclosure provides for devices, systems, and/or methods wherein cells are arranged in a reversible chamber or microchamber wherein the chamber and/or microchamber can be open and/or closed. The disclosure also provides for devices, systems, and/or methods wherein cells are arranged in reversible chamber or microchamber where the chamber and/or microchamber can be opened or closed as compared to devices, systems, and/or methods wherein cells are arranged in non-reversible droplets or a non-reversible configuration wherein cells are physically segregated from one another. In such a non-reversible configuration, the droplets and/or non-reversible configuration wherein cells are physically segregated cannot be readily toggled back and forth, that is, may not be opened or closed. As a result, in a non-reversible configuration, fluidics cannot be uniformly distributed to the cells and then uniformly removed and replaced by a second fluid.

The disclosure further provides for devices or system comprising
(a) one or more capture beads, for example mRNA capture beads;
(b) one or more cell-identifying barcode sequences, for example, optical barcode sequences;
(c) a plurality of chambers or microchambers including one or more mRNA capture beads and/or one or more cell-identifying barcode sequences;
(d) wherein the plurality of chambers or microchambers including one or more mRNA capture beads and/or one or more cell-identifying barcode sequences are reversible and are capable of being opened or closed more than a single time.

In an aspect, the disclosure provides for devices or system comprising
(a) one or more mRNA capture beads;
(b) one or more cell-identifying barcode sequences;
(c) a plurality of chambers or microchambers including one or more mRNA capture beads and/or one or more cell-identifying barcode sequences;
(d) wherein the plurality of chambers or microchambers including one or more mRNA capture beads and/or one or more cell-identifying barcode sequences are reversible and are capable of being opened or closed more than a single time; and
(e) wherein the device or system does not comprise a droplet microfluidics device or does not include droplet microfluidic technology, nonoliter droplet technology, and/or droplet sequence, "Drop-seq," "Drop-seq single cell analysis" technology, and/or technology wherein cells are captured in "droplets."

The disclosure further provides for probes comprising one or more mRNA capture beads and one or more cell-identifying barcode sequences associated or coupled with the one or more mRNA capture beads.

The disclosure further provides for compositions comprising one or more mRNA capture beads and one or more cell-identifying barcode sequences associated or coupled with the one or more mRNA capture beads and one or more cells.

The disclosure further provides for methods of drug discovery, drug profiling, and/or drug testing comprising
(a) combining one or more mRNA capture beads with one or more cell-identifying barcode sequences;
(b) adding one or more mRNA capture beads with one or more cell-identifying barcode sequences to a plurality of chambers or microchambers;
(c) wherein the plurality of chambers or microchambers including one or more mRNA capture beads and one or more cell-identifying barcode sequences are reversible; and
(d) adding one or more drugs to the reversible chambers or reversible microchambers.

The disclosure further provides for a probe comprising
(a) one or more mRNA capture beads;
(b) one or more cell-identifying barcode sequences, for example, optical barcode sequences;
(c) a plurality of chambers or microchambers including one or more mRNA capture beads and/or one or more cell-identifying barcode sequences;
(d) wherein the plurality of chambers or microchambers including one or more mRNA capture beads and/or one or more cell-identifying barcode sequences are reversible and are capable of being opened or closed more than a single time The disclosure further provides for methods for single cell RNA capture and sequencing, wherein said method comprises
(a) introducing at least one cell into a microwell, wherein the microwell is attached to a first substrate that faces a second substrate and wherein oligo primers are attached to the surface of said second substrate;
(b) hybridizing mRNA molecules to the surface of said second substrate;
(c) adding at least one buffer to the microwell;
(d) contacting said first substrate with said second substrate, thereby creating a seal between said first substrate and said second substrate.

In an aspect, the device, system, and/or microarray is imaged using fluorescence.

In another aspect, the disclosure provides for a device for single cell RNA capture and sequencing, wherein said device comprises a plurality of microwells; wherein said plurality of microwells are attached to a first polysiloxane substrate; a second substrate comprising glass that faces said first substrate, wherein oligo primers are grafted onto to the glass surface of said second substrate.

In an aspect, the substrate or surface comprises a polysiloxane substrate. In an aspect, the polysiloxane substrate comprises PDMS. In another aspect, the substrate comprises polymethylmethyacrylate (PMMA). In another aspect, the substrate comprises a thermoplastic for fabrication by, for example, hot embossing. In another aspect, the substrate comprises glass for fabrication by, for example laser machining. In another aspect, the substrate comprises silicon or silicon-on-glass or photoresist-on-silicon.

In another aspect, a system or device described herein further comprises one or more drugs, buffers, active agents, and/or a plurality of cells.

In an aspect, the disclosure provides for devices, systems, methods, and/or probes capable of profiling hundreds or thousands of cells from an organ or tumor. In an aspect, the cells analyzed are healthy human cells, abnormal cells, cancer cells, neural cells, immune cells, epithelial cells, mesenchymal cells, or stem cells. Cells could also originate from microorganisms including parasites, fungi, or bacteria. Other units containing nucleic acids such as viruses both in isolation or inside of an infected host cell could be analyzed.

In yet another aspect, different drugs or chemical constituents or compositions, for example, lysis buffer, may be introduced to a device or system described herein, for example, in a chamber or microchamber, at any time given the reversible nature of the chambers or microchambers. This provides for additional flexibility and advantages over other devices or systems, such as those employing, for example, droplet microfluidic technology, nanoliter droplet technology, and/or droplet sequence, "Drop-seq," "Drop-seq single cell analysis" technology, and/or technology where cells are captured in "droplets."

In an aspect, the device or system described herein, for example, the microfluidic device does not involve any on-chip valves and/or moving parts, which can result in a high feature density. In another aspect, the device or system described herein is not a droplet microfluidics device or does not include droplet microfluidic technology, nonoliter droplet technology, and/or droplet sequence, "Drop-seq," "Drop-seq single cell analysis" technology, and/or technology where cells are captured in "droplets." In an aspect, the device or system described herein is more compatible with cell culture and cell perturbation assays than a droplet microfluidic device because fluids can be readily exchanged in a uniform fashion and cells can communicate with each other via diffusible factors. Hence, cell viability will be higher and cells will exhibit normal physiology in comparison to cells that are sequestered in droplets. In another aspect, in the device or system described herein, cell are arranged in regular array and are in contact with a flat, optically transparent surface as opposed to a droplet microfluidic device in which cells are isolated inside of a spherical enclosure. Therefore, in yet another aspect, the device or system described herein is intrinsically more compatible with imaging, for example optical imaging or microscopy, than droplet devices.

In an aspect, devices, systems, and methods described herein have a higher throughput than devices, systems, or methods employing droplet microfluidic technology, nonoliter droplet technology, and/or droplet sequence, "Drop-seq," "Drop-seq single cell analysis" technology, and/or technology where cells are captured in "droplets." In yet another aspect, analysis of cells, probes, and beads using devices, systems, and methods described herein have a throughput that is 5, 10, 15, 20, 25, or 100 or more times less expensive than devices, systems, or methods employing droplet microfluidic technology, nonoliter droplet technology, and/or droplet sequence, "Drop-seq," "Drop-seq single cell analysis" technology, and/or technology were cells are captured in "droplets."

In another aspect, the device described herein is compatible with automation, for example, a computer-controlled system that is capable of facilitating automated introduction of any of various fluids to the device, temperature control, and reversible sealing of the microwells. Accordingly, in a preferred aspect the device described herein can capture mRNA from thousands of individual cells in parallel and produce pooled, single cell RNA-Seq libraries for ~$0.10/cell.

In an aspect, barcoded capture beads are introduced to the microwell array in either a random process or ordered process. In yet another aspect, barcoded capture beads are introduced into the microwell array in a random process with little or no control over which barcoded capture bead enter each microwell. Under such a scenario, in an aspect, imaging information acquired from the cells in the device is not directly associated with the single cell transcriptomes that ultimately are quantified by deep sequencing. In an aspect, this issue is addressed by introducing barcodes, for example, optical barcodes, to the mRNA capture beads that indicate the sequence barcode attached to each bead. In another aspect, the optical barcodes can be read out using the same or different fluorescence microscope used for live cell imaging on the device. In yet another aspect, the disclosure provides for a reagent that allows for the capture RNA from individual cells, allows for association of a unique sequence barcode with each single cell cDNA library, and/or reveals the identity of the attached sequence barcode by optical methods.

In an aspect, the disclosure provides for an optical barcode and associated methods described herein. In an aspect, the optical barcode is a sequence. In another aspect, the optical barcode is not a sequence. In another aspect, optical barcodes described herein are not DNA sequences.

In an aspect, an optical barcode described herein comprises a combination of fluorescent dyes comprising at least one different color and optionally more than one different intensity that make the bead uniquely identifiable on an optical microscope. In another aspect, an optical barcode described herein comprises a combination of fluorescent dyes comprising two, three, four, five or more different colors and optionally more than one different intensity that make a respective bead uniquely identifiable on an optical microscope.

The disclosure further provides for proteomic methods and systems utilizing a device, probe, or bead described herein. In an aspect, an oligonucleotide-based optical barcode is loaded onto beads that also harbor reactive groups for capturing protein (e.g. amine-, carboxyl-, or thiol-reactive groups). In yet another aspect, optical barcodes are loaded onto beads along with one or more antibodies capable of capturing specific proteins. Proteins can be quantified by fluorescence methods (e.g. fluorescently labeled antibodies) or mass spectrometry. In a further aspect, the disclosure provides for the use of DNA-labeled antibodies that are amplified, identified, and quantified by deep sequencing.

The devices, systems, and methods described herein provide for key distinctions and advantages over other devices, systems, and methods. For example, the microwell array device is constructed in such a way that it can be reversibly sealed during cell lysis and RNA capture. Significant loss of RNA occurs in our arrays when cells are lysed in unsealed or even imperfectly sealed arrays due to rapid diffusion of RNA molecules. In the context of the bead capture and RNA-Seq experiments, this could result not only in reduced RNA capture, but also significant cross-talk. Herein, advantage is taken of the physical properties of PDMS, namely its flexibility and hydrophobicity, for high-fidelity, reversible sealing which is difficult to achieve using the agarose hydrogel device reported previously. In addition, the devices, systems, and methods described herein demonstrate genome-wide single cell RNA-Seq. Additionally, the single cell capture and pooled library preparation scheme described herein costs $0.10-$0.20/cell even at a relatively modest scale of several hundred cells per run (see, for example, Table 7), compared to the <$1/cell estimated at the 10,000-cell scale for alternative approach, for example, one described in Fan H C, Fu G K, Fodor SPA: Combinatorial labeling of single cells for gene expression cytometry. Science 2015, 347:628-636, which is herein incorporated by reference in its entirety.

In an aspect, the disclosure provides for optical demultiplexing or optical barcoding of sequence-barcoded capture beads by, for example, attaching a unique combination of short oligonucleotides to each bead. In an aspect, while the sequence barcode associated with the RNA capture primer can be read out by DNA sequencing, the optical barcode can be read out on a standard fluorescence microscope. In another aspect, the oligonucleotide combination is unique to each sequence barcode and can be identified by hybridizing fluorescently labeled complementary oligonucleotides to beads. The presence or absence of a series of fluorescently labeled oligonucleotides on each bead after hybridization indicates the unique combination of short oligonucleotides attached to each bead and therefore the sequence barcode attached to each bead. Once the sequence barcode attached to each bead is identified, single cell transcriptome captured on each bead can be identified and read out using a sequencer with phenotypic information obtained from imaging the cells associated with each bead in each microwell of our device.

In an aspect, optical barcoding technology described herein is combined with applications beyond single cell RNA-Seq. In an aspect, an extension of the invention is bulk RNA-Seq or RNA-Seq of small numbers of cells. These can be seeded in the microwells or propagated from a single cell seeded in each microwell. The disclosure further provides for single cell DNA-Seq. The disclosure further provides for barcoded capture oligonucleotides that contain oligo(dT) for capturing mRNA from individual eukaryotic cells. Alternatively, the beads are functionalized with primers that are specific to targeted DNA loci or RNA transcripts. In yet another aspect, the beads are functionalized with primers that have a random sequence and can therefore capture any DNA or RNA sequence from an individual cell. In an aspect, in each case, a corresponding optical barcode is used to link imaging data acquired for a target cell or group of cells and sequencing data acquired from whatever nucleic acids are captured on the bead.

The disclosure further provides for proteomic methods and systems utilizing a device described herein. In an aspect, an oligonucleotide-based optical barcode is loaded onto beads that also harbor reactive groups for capturing protein (e.g. amine-, carboxyl-, or thiol-reactive groups). In yet another aspect, optical barcodes are loaded onto beads along with one or more antibodies capable of capturing specific proteins. Proteins can be quantified by fluorescence methods (e.g. fluorescently labeled antibodies) or mass spectrometry. In a further aspect, the disclosure provides for the use of DNA-labeled antibodies that are amplified, identified, and quantified by deep sequencing.

Single cell analysis is important for understanding how cells respond to drugs and other perturbations because phenotypic responses are inherently asynchronous.

PDMS Microwell Flow Cell for Single Cell Transcriptome Capture

In an aspect, the microfluidic platform described herein comprises a flow cell with an array of microwells embedded in either the top or bottom of the device. In an aspect, the device or system described herein comprises a high-throughput DNA sequencing and digital PCR device, as described in, for example, White A K, Vanlnsberghe M, Petriv Hamidi M, Sikorski D, Marra M A, Piret J, Aparicio S, Hansen C L: High-throughput microfluidic single-cell RT-qPCR. *Proceedings of the National Academy of Sciences of the U.S. Pat. No.* 2011, 108(34):13999-14004 or Men Y, Fu Y, Chen Z, Sims P A, Greenleaf W J, Huang Y: Digital polymerase chain reaction in an array of femtoliter polydimethylsiloxane microreactors. *Anal Chem* 2012, 84(10):4262-4266, the contents of which are incorporated by reference herein in their entirety.

In an aspect, fluids can be driven through the flow cell manually by, for example, laminar flow using a syringe or pipette. Fluid exchange in the microwells occurs by diffusion, while cells and beads can be loaded by gravity. The microwell arrays may be fabricated from, a polysiloxane substrate, for example, polydimethylsiloxane (PDMS), a silicone rubber commonly used in soft lithography. PDMS allows inexpensive, rapid, and repeatable fabrication from molds produced on silicon in photoresist using standard photolithography. See, for example, McDonald J C, Whitesides G M: Poly(dimethylsiloxane) as a material for fabricating microfluidic devices. *Accounts of chemical research* 2002, 35(7):491-499 and *First Single Cell Expression Analysis with PDMS*, Marcus et al., *Analytical Chemistry*, 2006. (Quake Lab), which are herein incorporated by reference in their entirety. In addition, the material properties of PDMS, including its hydrophobicity and flexibility, facilitate reversible sealing of the microwells against a flat surface using mechanical deformation and negative pressure (see, for example, FIG. 2A) or introduction of oil by laminar flow (See, for example, FIG. 3A).

In an aspect, the device or system described herein is capable of solid-phase capture of RNA from individual cells via two modes of operation—RNA "printing" on glass and RNA capture on beads. For example, in an aspect, in RNA printing mode, individual cells are loaded in the microwells, which are fabricated in a PDMS slab that faces a glass coverslip. Oligo(dT) primers are covalently grafted to the glass surface so that mature mRNA molecules can be immobilized by hybridization of their poly(A) tails. Following the introduction of lysis buffer, the microwells can be sealed by mechanically placing them in conformal contact with the functionalized glass surface. Cell lysis releases mRNA into the solution confined by the microwells, resulting in hybridization to the oligo(dT)-coated glass coverslip. By placing the flow channel under negative pressure, the seal can be maintained in the absence of mechanical force, making the device transportable and readily accessible to an optical microscope. See, for example, White A K, Vanlnsberghe M, Petriv O I, Hamidi M, Sikorski D, Marra M A, Piret J, Aparicio S, Hansen C L: High-throughput microfluidic single-cell RT-qPCR. *Proceedings of the National Academy of Sciences of the United States of America* 2011, 108(34):13999-14004, which is herein incorporated by reference in its entirety.

Because the mRNA is immobilized on a glass surface, enzymatic processing steps can take place on-chip, simply by sequential flow of reagents through the device. After incubating the trapped, single cell lysates with the glass capture surface, the seal may be released and the flow cell can be rinsed with a detergent-containing buffer followed by a reaction mixture containing DNase. Because the oligo(dT) primers are comprised of locked nucleic acid (LNA), they are resistant to nuclease digestion. See, for example, Koshkin A A, Nielsen P, Meldgaard M, Rajwanshi V K, Singh S K, Wengel J: LNA (locked nucleic acid): an RNA mimic forming exceedingly stable LNA: LNA duplexes. *Journal of the American Chemical Society* 1998, 120(50):13252-13253, the content of which is incorporated by reference in its entirety.

The immobilized single cell mRNA libraries can then be reverse transcribed in parallel, and the resulting mRNA/cDNA hybrids can be visualized by fluorescence microscopy after staining with a fluorogenic intercalator dye. For example, FIG. 4B illustrates a fluorescence image of single cell transcriptome "prints" arrayed on a glass coverslip as described above. Here, it is further confirmed by running a control experiment that the printed material originates from RNA. While some aggregates of genomic DNA were not fully digested (but are reduced in intensity by DNase treatment), the disclosure further confirms that the vast majority of material imaged in the circular prints originates from RNA. For example, the left-most panel of FIG. 4C shows a bright field image of a microwell array in which three microwells each contain an individual cell. The resulting RNA prints (middle panel) that can be visualized after reverse transcription are ablated by incubating the surface with RNaseH (right-most panel), which selectively digests RNA in RNA/DNA hybrids. Conversion of RNA/DNA hybrids to single-stranded cDNA precludes detection using the intercalator dye, and so removal of RNA from the prints eliminates the fluorescence signal almost completely. FIG. 4C also contains some small fluorescent objects associated with the interstitial walls of the microwell array or with microwells that did not contain a cell. These are substantially reduced in intensity by RNase treatment, confirming that they are, in fact, RNA that is spuriously captured or non-specifically absorbed. These objects could arise due to contamination from dead cells or other sources of freely floating RNA introduced with the cells prior to sealing.

Nonetheless, the vast majority of the observed signal in FIG. 4C is associated with the circular mRNA prints that correlate perfectly with microwells that initially contained a cell.

Figure 2B:
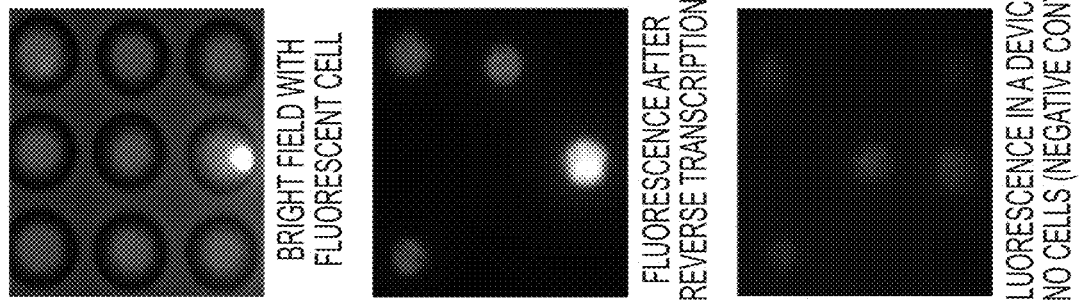
FIG. 2B contains images of single cell RNA capture on beads. The top panel is a bright field/fluorescence overlay of a microwell array in which four microwells contain a bead, but only one contains both a bead and a cell (fluorescently labeled with live stain). The middle panel is a fluorescence image of the array after RNA capture, reverse transcription, and staining with SYTOX Orange. Note that the bead associated with a cell is significantly brighter than the other beads. The bottom panel is a fluorescence image of beads in an array from a negative control experiment involving no RNA or cells, showing that the beads have a certain level of background fluorescence in the presence of stain, which explains the majority of the background signal observed in the beads with no cell in the middle panel.
Figure 4A:
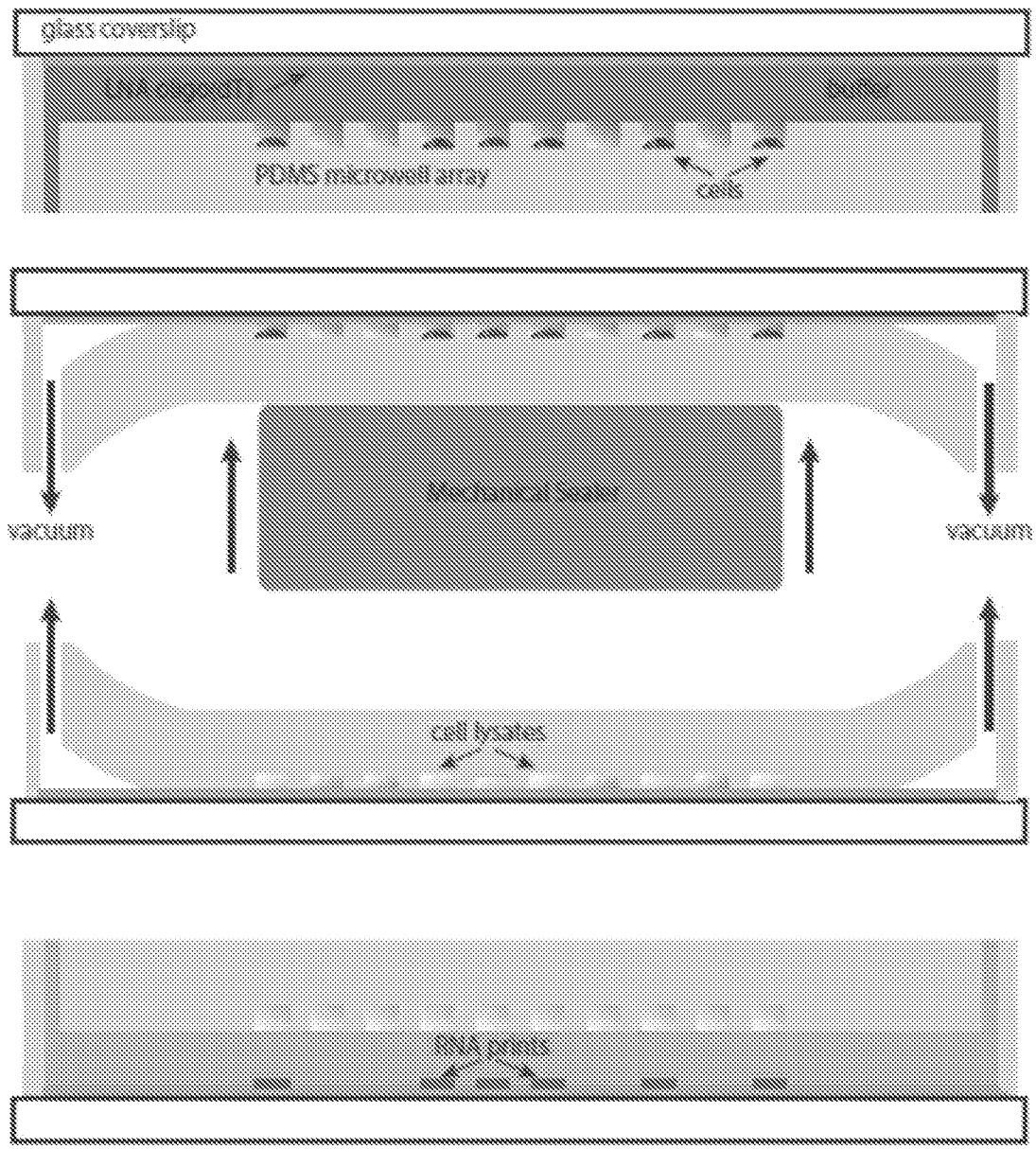
FIGS. 4A-4C provide for a schematic and fluorescence imaging data for single cell RNA printing.
Figure 4B:
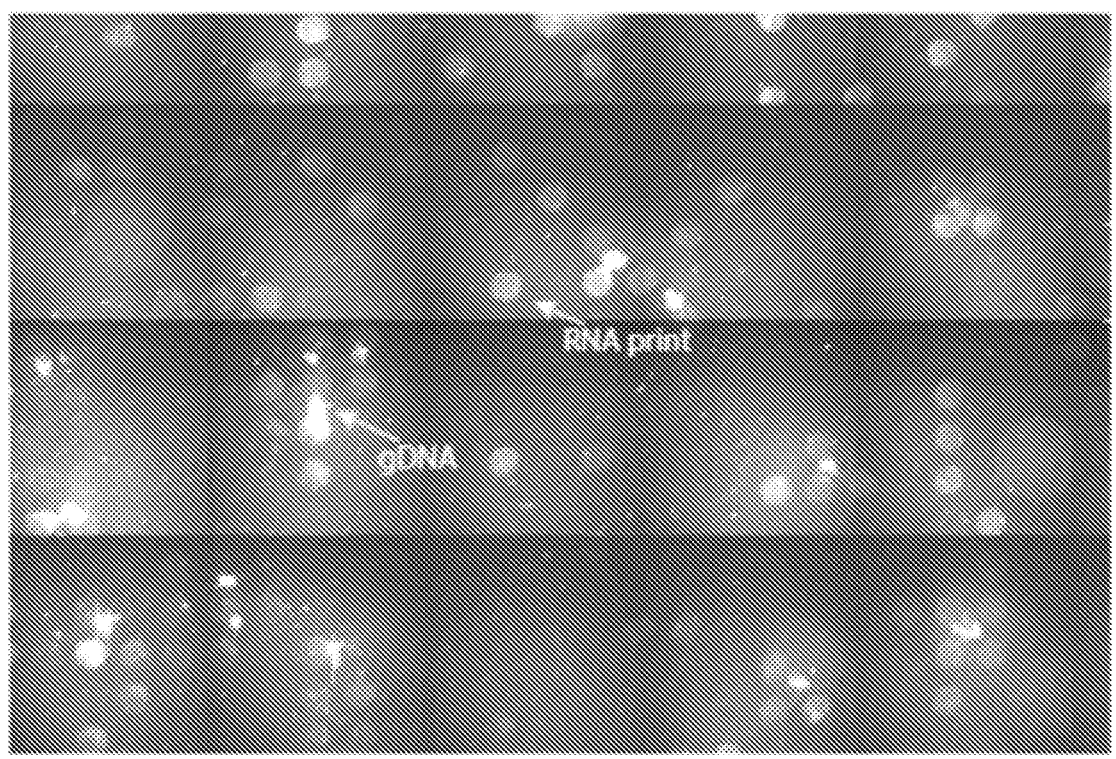
Figure 4C:
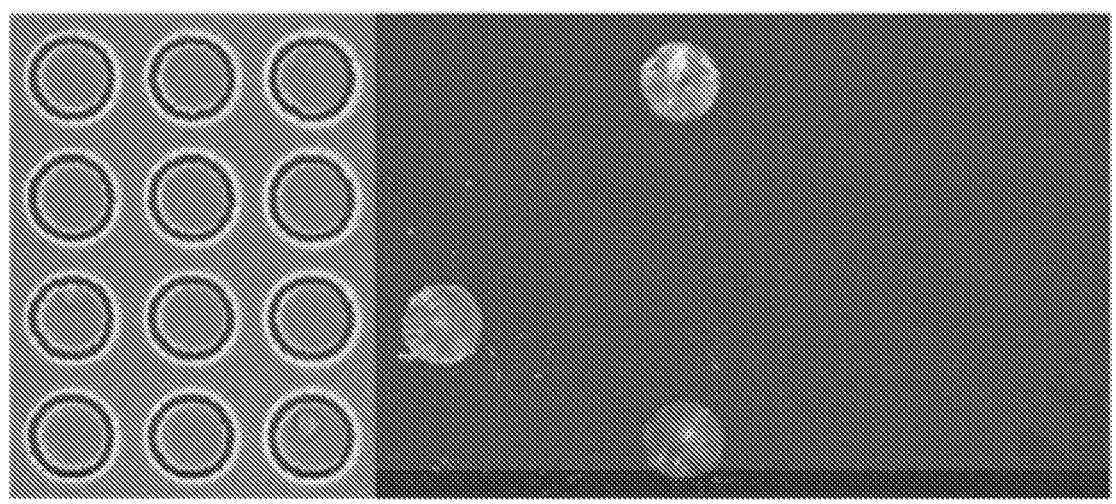

FIG. 4A shows a second, very similar version of the device where the microwells are fabricated in PDMS on a glass slide, and the sealing is accomplished by laminar flow of oil. Using nearly the same procedures as described above for RNA printing mode, we use this version of the device to capture RNA on beads. After introducing cells, we can load beads into the microwells by gravity and achieve super-Poisson loading by using beads with a mean diameter greater than the radius of the microwells. Like the glass surface in FIG. 4A, we coat the beads in oligo(dT) to facilitate mRNA capture after cell lysis and sealing. FIG. 2B shows bright field and fluorescence images of a bead-containing microwell array loaded with individual cells following solid-phase mRNA capture and reverse transcription. The bead contained in a microwell that also contains a cell is substantially more fluorescent following reverse transcription than the other beads. While there is some fluorescence signal associated with beads that do not contain a cell, this is mainly due to non-specific staining of the high-density of single-stranded primers on the bead surface and non-specific staining of the bead itself, as shown in the third panel of FIG. 2B where we depict fluorescence images of beads in the absence of cells, cell lysate, or RNA as a negative control.

A Scalable Platform for Single Cell RNA-Seq

A scalable platform for single cell RNA-Seq based on the bead capture modality is described herein. The low reagent volumes required for microfluidic processing result in a significant cost reduction relative to some conventional methods, for example, as described in Wu A R, Neff N F, Kalisky T, Dalerba P, Treutlein B, Rothenberg M E, Mburu F M, Mantalas G L, Sim S, Clarke M F et al: Quantitative assessment of single-cell RNA-sequencing methods. *Nat Methods* 2014, 11(1):41-46, which is herein incorporated by reference in its entirety.

A further reduction in cost can be realized by, for example, using microfluidics in combination with schemes for cDNA barcoding. A representative example of this, such as the CEL-Seq strategy, can be found in Hashimshony T, Wagner F, Sher N, Yanai I: CEL-Seq: single-cell RNA-Seq by multiplexed linear amplification. *Cell Rep* 2012, 2(3): 666-673, which is herein incorporated by reference in its entirety. By introducing a cell-specific barcode to the cDNA during reverse transcription, all subsequent sequencing library preparation steps can be accomplished on pooled cDNA from multiple cells, further reducing hands-on time and reagent consumption.

Figure 3A:
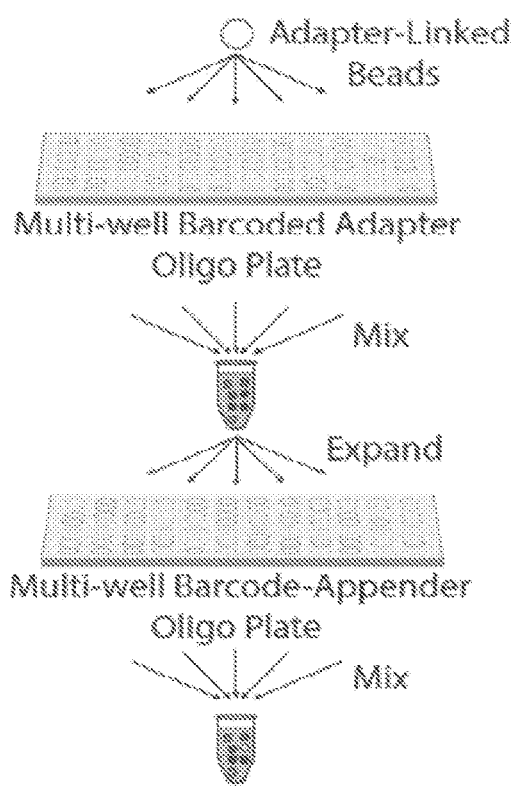
FIGS. 3A and 3B provide for combinatorial scheme for synthesis of barcoded capture beads.
Figure 3B:
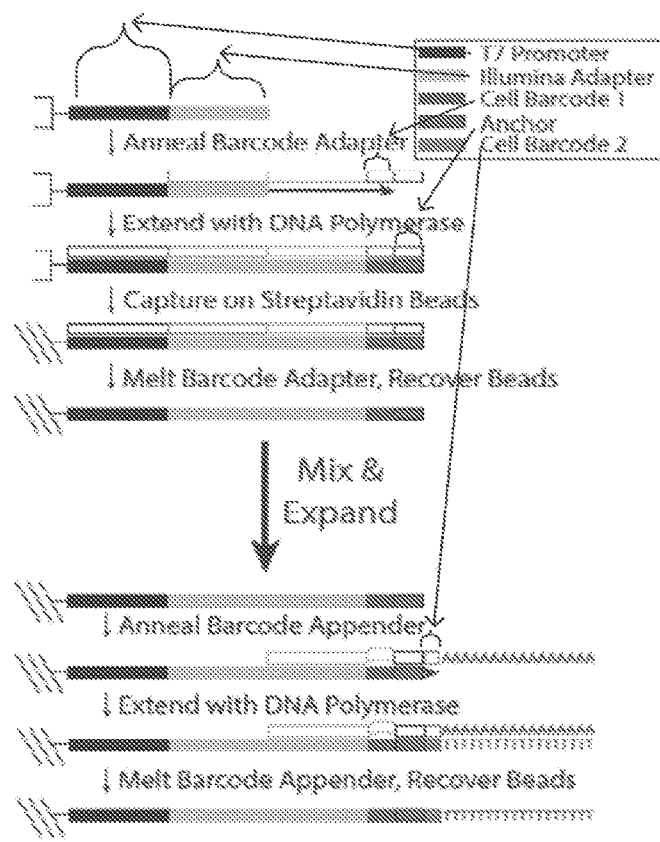

A pool of mRNA capture beads was generated in which each bead is attached to ~1 billion copies of a primer terminated on the 3'-end with one of 960 possible barcode sequences followed by oligo(dT) using a combinatorial synthesis technique (FIGS. 3A and 3B). If, for example, 100 cells loaded into the microwells of a device or system described herein receive a random barcoded bead from the pool, it is expected that the mRNA from ~95 of them would be uniquely labeled based on the binomial distribution. A copy of the T7 promoter sequence (TPS) and part of an Illumina sequencing adapter (ISA) comprise the 5'-end of the capture primer (Table 1) to allow linear pre-amplification by in vitro transcription (IVT) and library enrichment by PCR (FIG. 3B). To create this large pool of barcoded beads, 96 different barcode-containing oligonucleotides (Table 2) were copies onto a dual-biotinylated oligonucleotide containing TPS and ISA by primer extension with DNA polymerase in a 96-well plate. Each barcode is terminated with a universal, 6-base anchor sequence that becomes the 3'-end of the biotinylated oligonucleotide after the first round of primer extension (FIG. 3B). After this first reaction, each barcoded oligonucleotide was immobilized onto a set of streptavidin-coated Sepharose beads, quench the reaction, combine all of the barcoded beads in a pool, and remove original barcode-containing strand by denaturation. At this point, the pool of beads is split into ten new reactions and each containing one of ten unique second barcodes along with poly(dT) (Table 3) are added to the 3'-end of the immobilized oligonucleotide by primer extension from the universal anchor sequence (FIG. 3B). After quenching this reaction, the beads can be pooled, removing the unbiotinylated strands, and washed. The resulting pool of beads contains 960 barcoded capture primers.

A PDMS microwell device containing five flow channel lanes for physical multiplexing of samples and >10,000 microwells was constructed (FIG. 5A). The cylindrical microwells are about 50 μm in diameter and height with a volume of <100 pL. In another aspect, the microwells are about 100 μm to about 5 mm, about 5 μm to about 200 μm, about 10 μm to about 100 μm, about 25 μm to about 75 μm, about 30 μm to about 600 μm in diameter and height. In yet another aspect, the microwells comprise a volume of about 10 pL to about pL, about 10 pL to about 100 pL, about 25 pL to about 75 pL, about 25 pL to about 100 pL. In an aspect, cells are loaded in individual microwells randomly, according to Poisson statistics, such that the majority of cell-containing wells contain one cell. The concentration of the cellular suspension can be tuned in order to avoid overloading the microwell array. For example, if ~100 cells are captured in every 1,000 microwells of a given array, then about <5% of microwells will contain more than one cell. Beads can then be loaded into the wells at a somewhat higher density because the mean diameter of the beads (~30 μm) significantly reduces the probability double-loading (FIG. 5B and FIG. 5C). In an aspect, depending on the size of the microwell, it is rare to observe both beads and cells in an overloaded microwell. Given the pool of 960 cell-identifying barcodes and five lanes, the capacity of the system described herein for single cell RNA-Seq is ~600 cells at a unique barcoding rate of >94%. In another aspect, the capacity of the system described herein for single cell RNA-Seq is ~600 cells at a unique barcoding rate of about greater than 85%, greater than 90%, greater than 91%, greater than 92%, greater than 93%, greater than 94%, greater than 95% or more. In an aspect, the device or systems described herein may be scaled to increase capacity by synthesizing additional barcodes and/or adding microwells to the device or system.

After loading the cells and barcoded beads, procedures described above and herein can be employed to trap single cell lysates in sealed microwells, immobilizing captured mRNA on beads, and reverse transcribe (FIG. 5B). Following on-chip second-strand synthesis, the pool of single cell libraries can be simultaneously elute and pre-amplify overnight by IVT using T7 RNA polymerase (FIG. 5B). The resulting amplified RNA (aRNA) can be removed from each lane using a pipette, reverse transcribe the aRNA from each lane with primers containing lane-identifying barcodes, the cDNA libraries from all five lanes can be pooled, and enrichment of the sequencing library in a single PCR reaction can be undertaken. The primers used for aRNA reverse transcription contain 8-base unique molecular identifiers (UMIs) so that the vast majority of cDNA molecules are distinguishable. That way, genes can be quantified from sequencing data based on the number of UMIs associated with each gene rather than the number of reads, mitigating noise and bias that result from exponential amplification by PCR. See, for example, Shiroguchi K, Jia T Z, Sims P A, Xie X S: Digital RNA sequencing minimizes sequence-dependent bias and amplification noise with optimized single-molecule barcodes. *Proceedings of the National Academy of Sciences* 2012, 109(4):1347-1352 and Shiroguchi K, Jia T Z, Sims P A, Xie X S: Digital RNA sequencing minimizes sequence-dependent bias and amplification noise with optimized single-molecule barcodes. *Proceedings of the National Academy of Sciences* 2012, 109(4):1347-1352, which are incorporated by reference in their entirety.

Demonstration and Analysis of Highly Multiplexed Single Cell RNA-Seq

In an aspect, the microfluidic device described herein is used to obtain RNA-Seq profiles from ~600 cells across five lanes from two commonly used human cancer cell lines (described herein as "Experiment 1" throughout the text). One of the five lanes contained U87 human glioma cells, one contained MCF10a human breast cancer cells, and the other three contained a mixture of both cell lines. These two cell lines are highly mesenchymal, have been cultured for numerous passages, and have relatively similar expression profiles. Nonetheless, they are distinguishable by a few key genes and can be readily separated the data set. In addition, in an aspect, a slightly different protocol with less expensive reagents are used to obtain profiles of ~500 cells across five lanes for a different cell pair (U87 cells and the diploid cell line WI-38, which has not undergone malignant transformation) in Experiment 2.

A factor with any pooled library scheme is cross-talk between cell-identifying barcodes. As described herein, this issue is addressed by quantitative analysis of Experiment 1. For example, the disclosure provides for methodology wherein cross-talk is quantified by using both sequencing and imaging data. In an aspect, because the device or system described herein is compatible with fluorescence microscopy, a fraction of the streptavidin molecules on each bead can be labelled with red-fluorescent AlexaFluor 647 and pre-stained the cells with a blue-excitable live stain. This allows quantification of the number of cells paired with a barcoded capture bead and also allows for the estimation of the number of barcodes that are expected to be observed in the sequencing data for each lane. The sequencing data reveals that more barcodes are present in the library for each lane than expected based on the imaging data. Analysis reveals that the number of molecules associated with a given barcode placed the barcodes in two distinct populations. The size of the population of barcodes associated with a larger number of molecules was highly consistent with the imaging data (within −8%), which we take to demarcate our single cell RNA-Seq profiles. The second, larger population of barcodes with relatively few associated molecules likely results from multiple potential sources including sequencing error, actual cross-talk or spurious capture within our microfluidic device, and PCR jumping as observed in other implementations of multiplex single cell RNA-Seq. Across all five lanes the cell-identifying barcodes that were not associated with actual cells in the device had 200-300×fewer molecules per barcode than those associated with cells (based on the ratio of median unique molecules in the two populations).

Figure 6A:
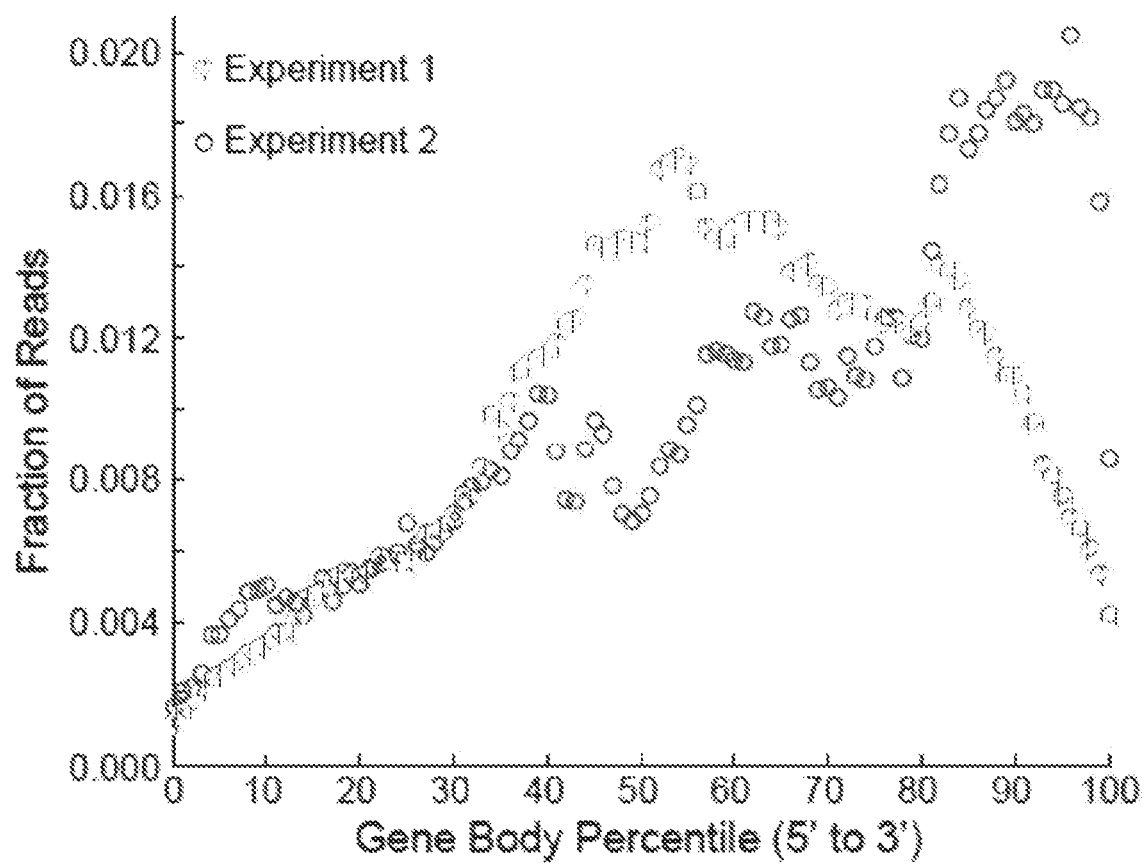
FIGS. 6A and 6B show an analysis of single cell RNA-Seq data.
Figure 6B:
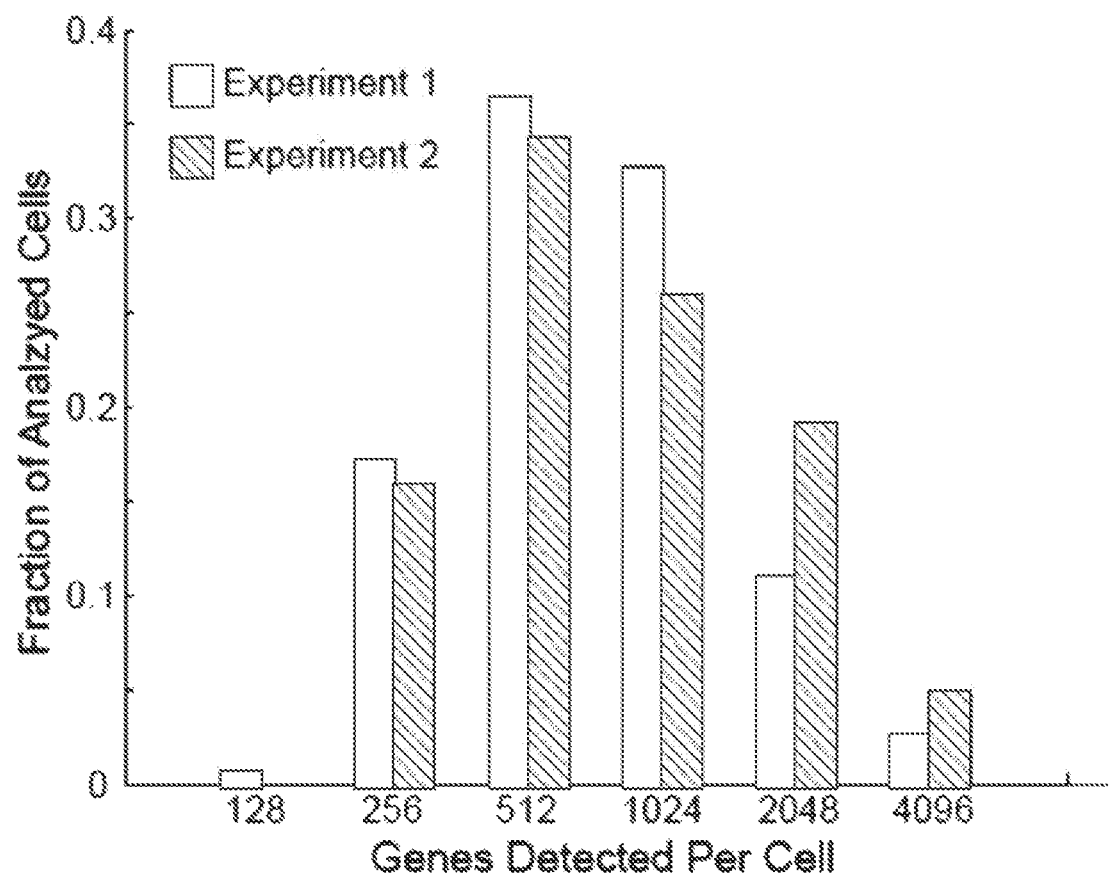

As described in FIGS. 6A and 6B, the systems and devices described herein produce useful single cell RNA-Seq profiles. For example, in an aspect, the library preparation protocol described herein is based on CEL-Seq where, rather than sequencing the full gene body and normalizing by transcript length, the 3'-end of transcripts are sequenced and counted. FIGS. 6A and 6B show the expected distribution of mapping positions for 3'-end sequencing, with most reads mapping to the 3'-UTRs or coding sequences. Subsequent analysis to demonstrate cell type separation using our data set will rely on the 396 single cell profiles that we obtained with the highest coverage. Although 635 genes on average were detected across all cell profiled in Experiment 1, an average of 876 genes from the top 396 cells were detected (FIG. 6B). Hence, the 204 cells that we discard from subsequent analysis have an average of ~170 genes detected per cell. Similarly, for Experiment 2, an average of 1,030 genes from the top 247 single cell profiles were detected, but 18 530 genes on average across all cells.

Figure 7A:
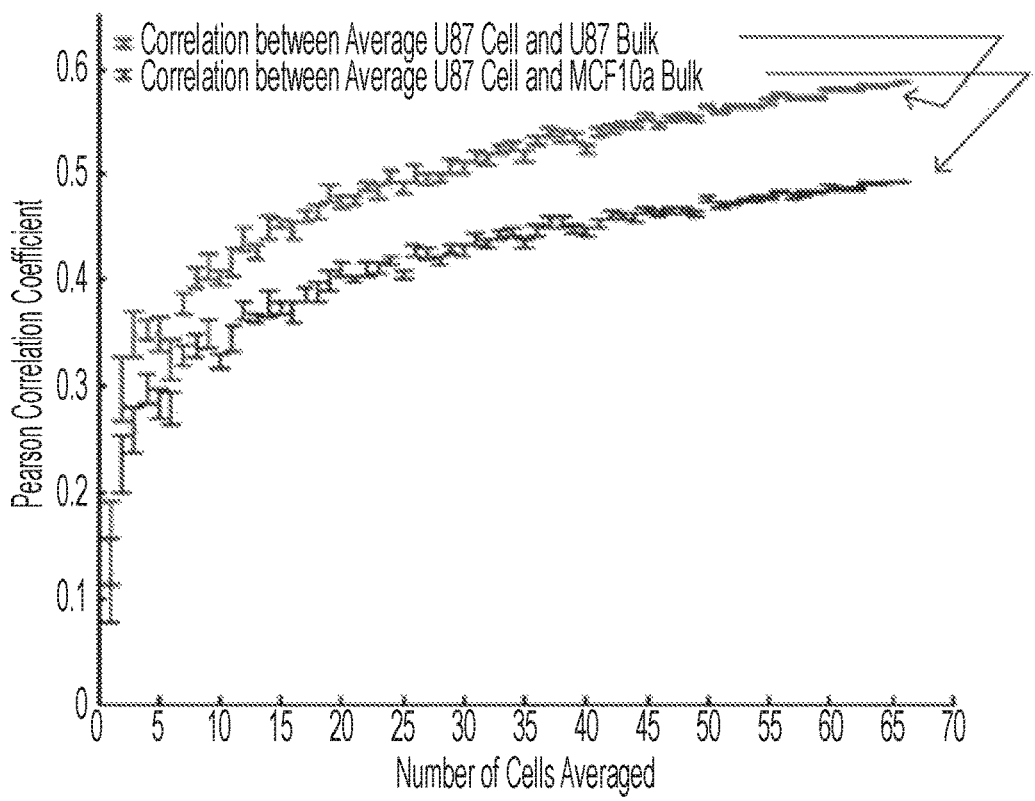
FIGS. 7A-7C provide for (FIG. 7A) a comparison of single cell median and population-level RNA-Seq profiles for cells originating from the U87-exclusive lane in Experiment 1. Each data point was obtained by constructing a median profile from a given number of cells and repeating this ten times by random sampling with replacement to obtain a median Pearson correlation coefficient and error bar (SEM). This exercise was repeated for comparison to both the U87 and MCF10a bulk RNA-Seq profiles to demonstrate better concordance between the U87 single cell profiles and the U87 bulk profile.
Figure 7B:
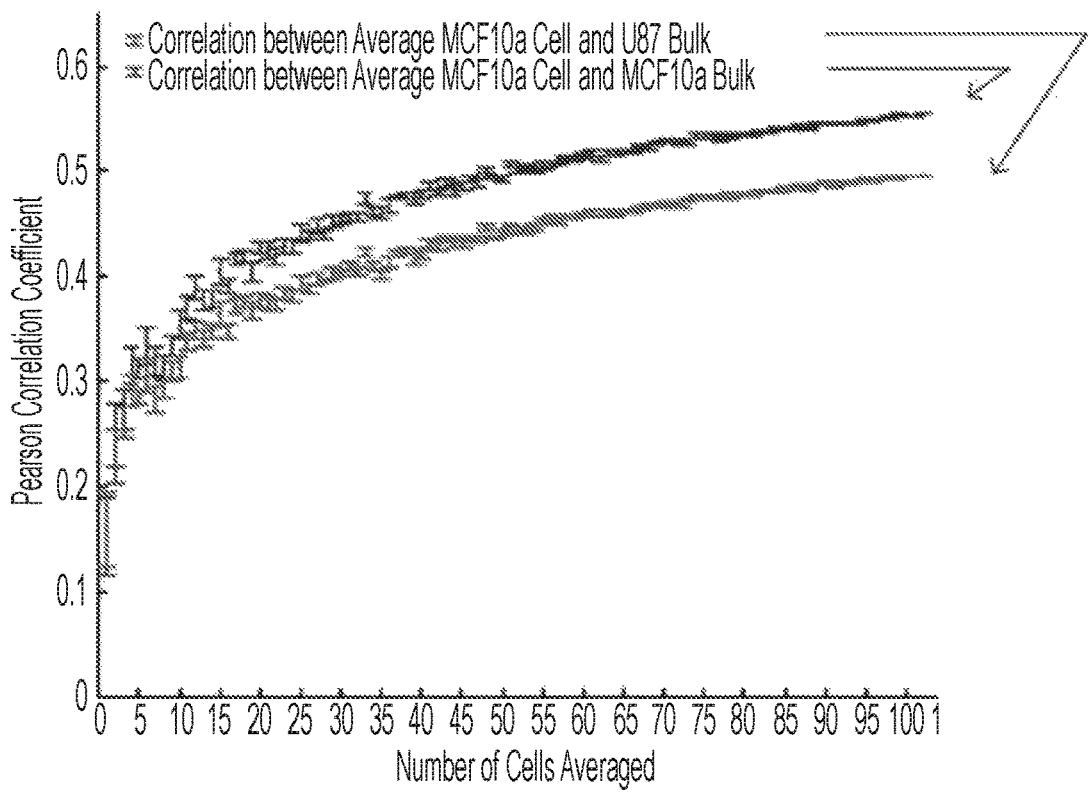

To assess the similarity of our single cell expression profiles to conventional, population-level RNA-Seq, the Pearson correlation between bulk RNA-Seq and single-cell medians constructed from different numbers of individual cells after normalizing by the total number of molecules detected in each cell were calculated (FIG. 7A and FIG. 7B). An analysis on single cell profiles originating from the U87-exclusive and MCF10a-exclusive lanes in Experiment 1 was conducted, randomly sampling the complete sets of profiles ten times without replacement for each point in the curves shown in FIG. 7A and FIG. 7B. This analysis shows that the single cell medians constructed from U87 single cell profiles correlate better with the bulk U87 RNA-Seq profile than with the bulk MCF10a RNA-Seq profile (FIG. 7A), and vice-versa (FIG. 7B). It also shows that the single cell median correlations saturate around $r=0.55$-$0.60$ depending on the cell type. As a point of comparison, an analysis for CEL-Seq and DR-Seq gave population-level Pearson correlations of 0.71 and 0.69, respectively. See, for example, Dey S S, Kester L, Spanjaard B, Bienko M, van Oudenaarden A: Integrated genome and transcriptome sequencing of the same cell. *Nat Biotechnol* 2015, 33(3):285-289, which is herein incorporated by reference in its entirety.

Figure 7C:
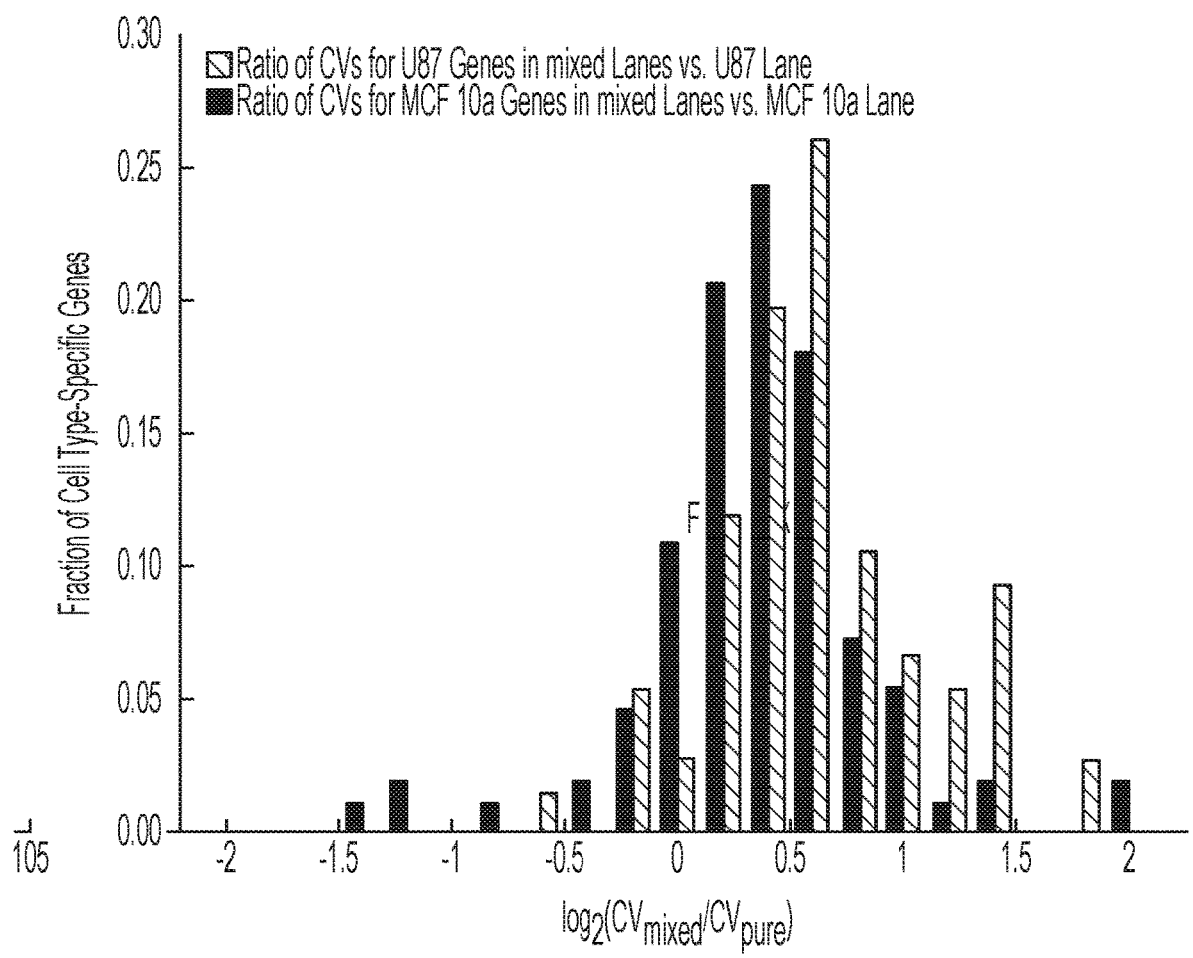

To further demonstrate the robustness of our data set, classifier for U87 and MCF10a cells in Experiment 1 were built. Single cell profiles from lanes that contained either exclusively U87 cells of MCF10a cells were used to identify 189 differentially expressed genes ($p<0.05$, Wilcoxin rank-sum test). FIG. 7C shows the log-ratio of the coefficients of variation (CVs) for each of these two genes sets between the mixed lane profiles and the profiles from the respective pure lanes. The log-ratio of CVs is greater than zero (CV ratio greater than one) for 92% of U87-specific genes and 85% of MCF10a-specific genes.

Figure 8A:
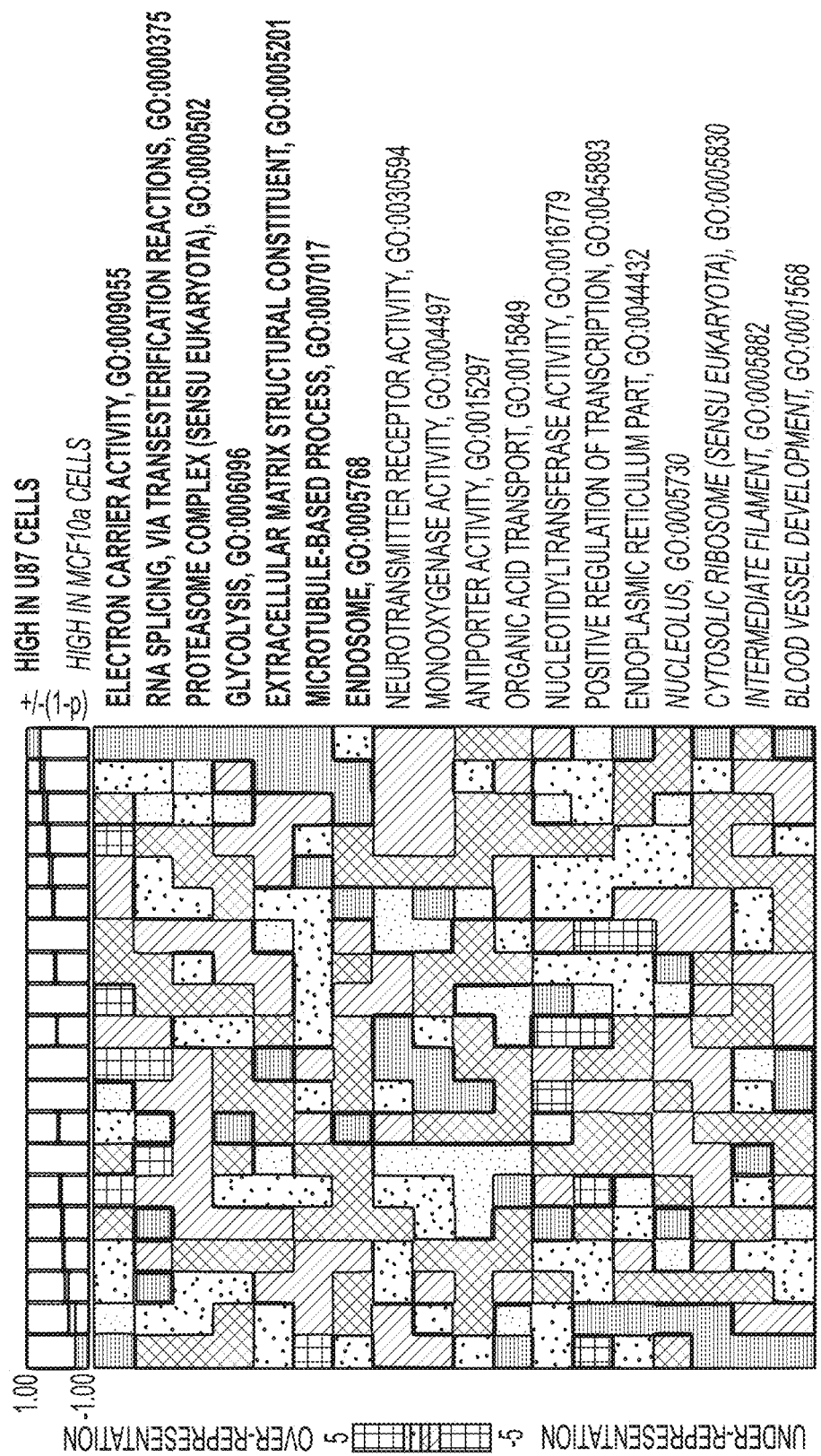
FIGS. 8A-8C provide for cell type separation by single cell RNA-Seq.
Figure 8B:
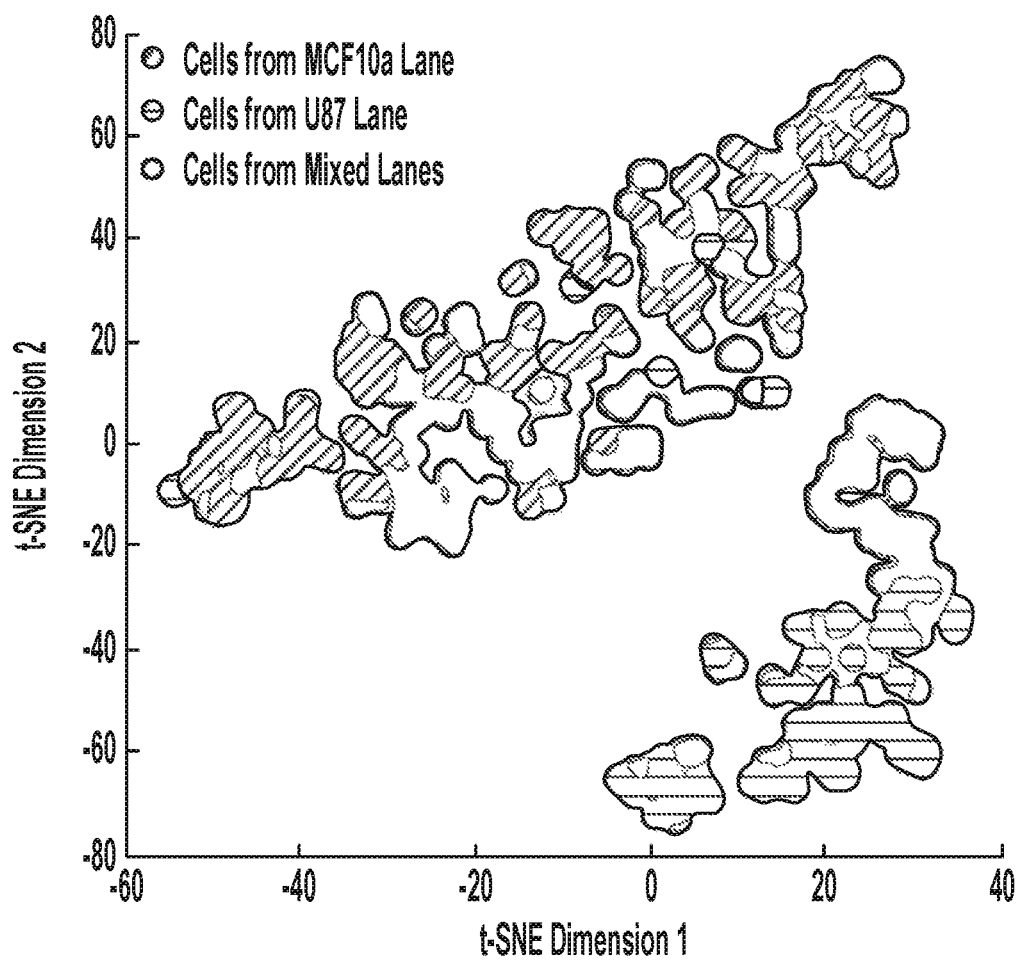
Figure 8C:
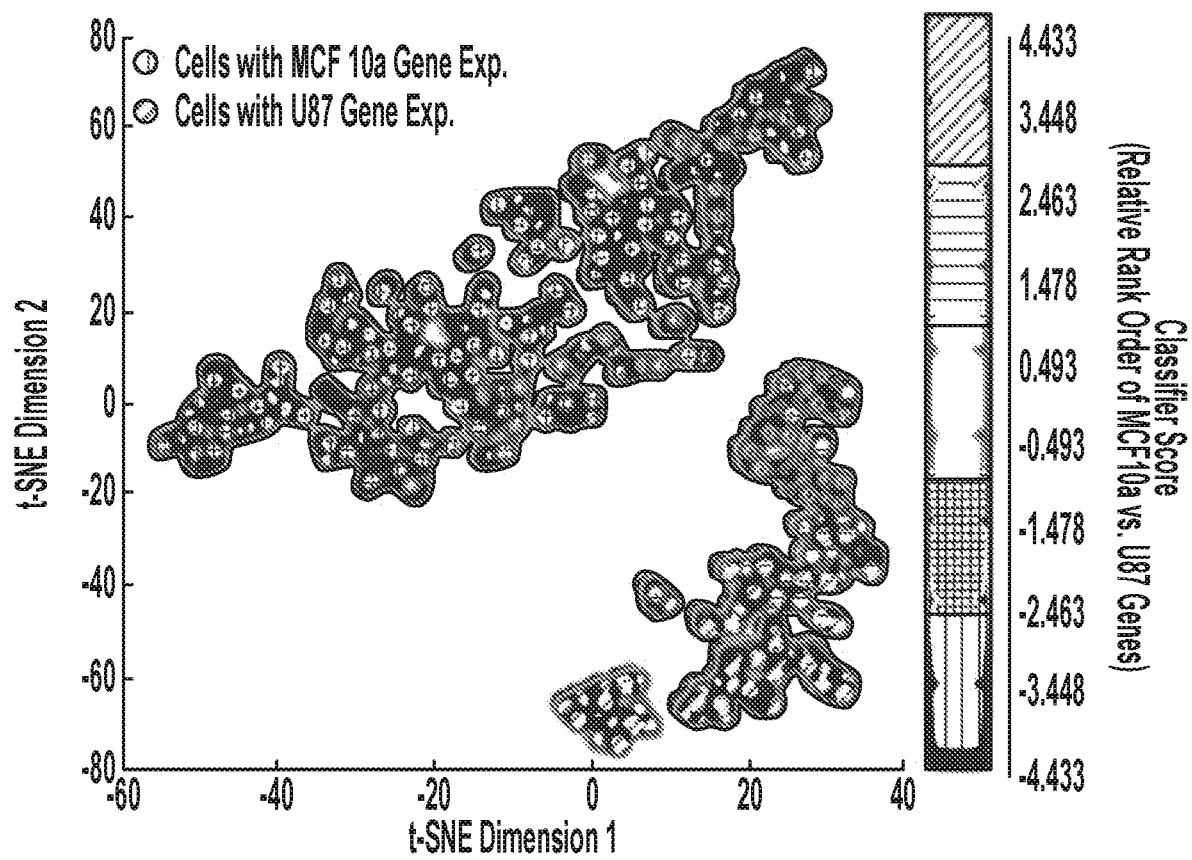
Figure 9:
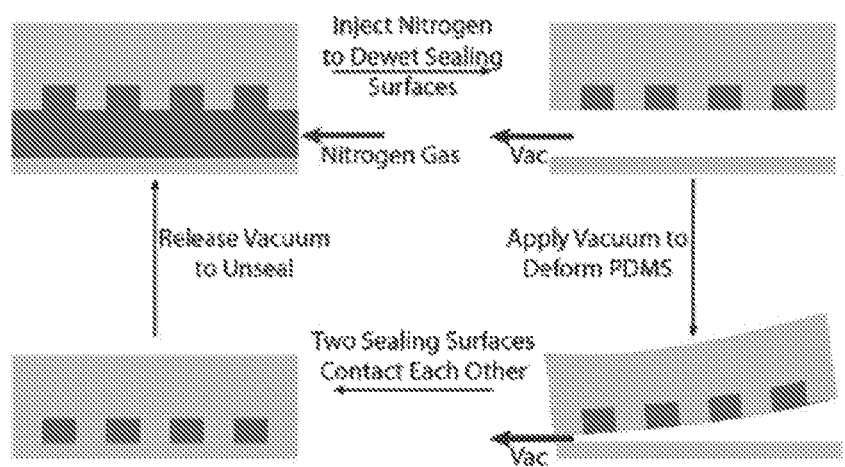
FIG. 9 provides for a schematic of a reversible PDMS-based device in one aspect of the disclosure.
Figure 10:
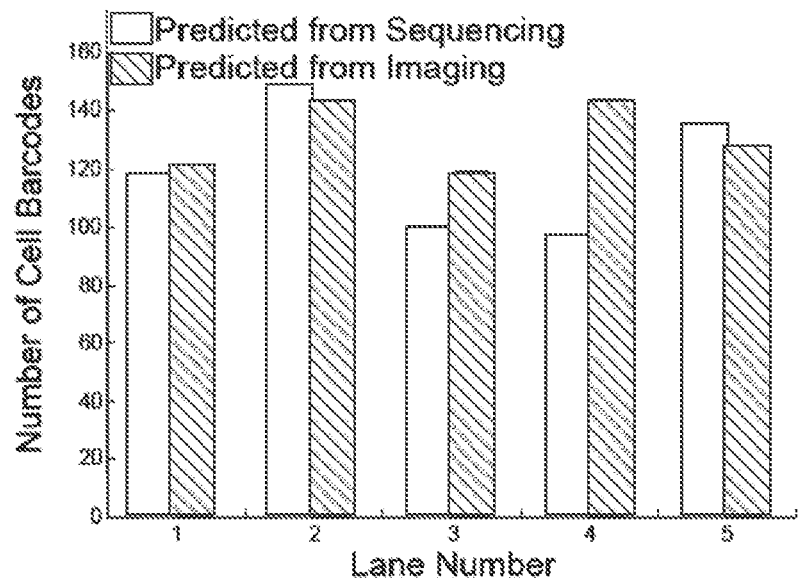
FIG. 10 describes ingle Cell RNA-Seq of U87 and MCF10a Cell Lines ~600 cells paired with beads in five-lane microfluidic device.
Figure 11:
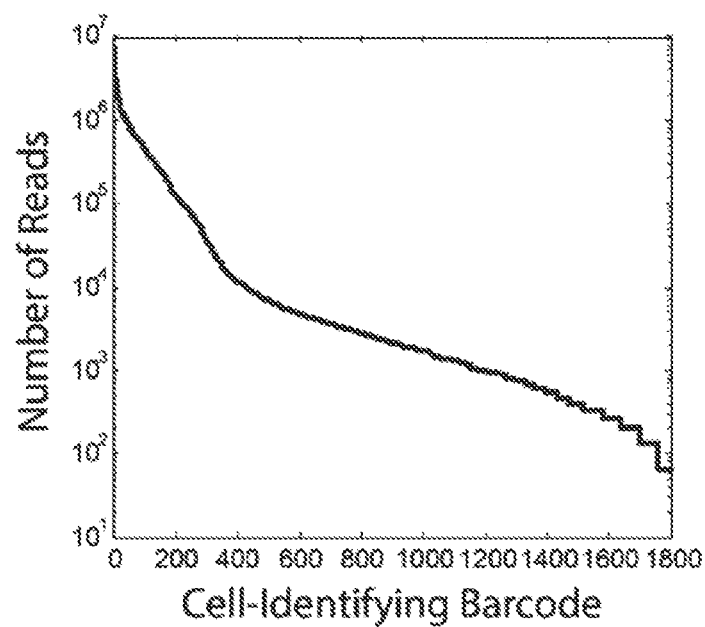
FIG. 11 shows the number of reads associated with each cell-identifying barcode showing a sharp change in slope at ~350 barcodes, consistent with the ~350 cell-bead pairs loaded in the microwell array. The remaining cell-identifying barcodes originate either from sequencing error or ambient, background mRNA hybridizing to beads in the device that were not associated with a cell.
Figure 12:
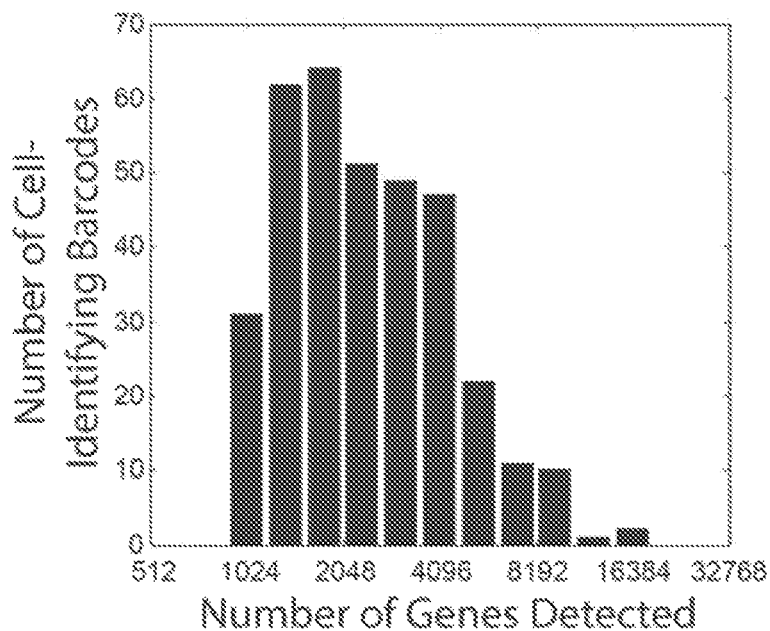
FIG. 12 is a histogram showing that the number of genes detected per individual cell ranges from 1,000 to 17,000 (~3,400 genes per cell on average).
Figure 13A:
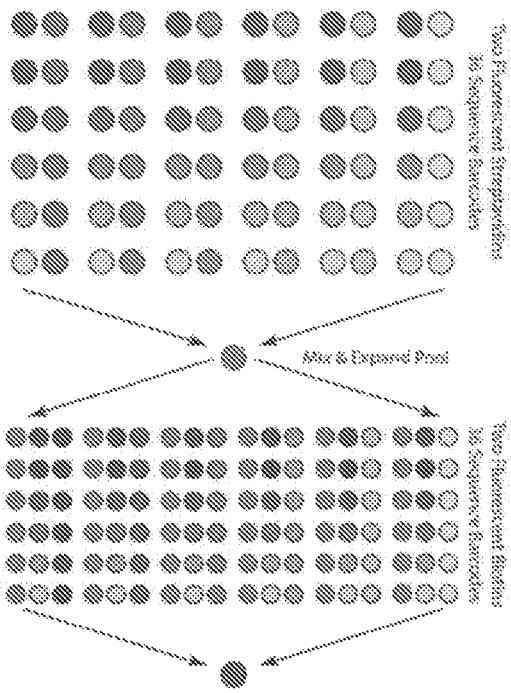
FIG. 13A and FIG. 13B describes a representative example of the capabilities described herein for linking high content imaging to single cell sequencing. For example, introducing 4 different at 6 intensities generates $6^4$ or 1296 optical barcodes (FIG. 13A).
Figure 13B:
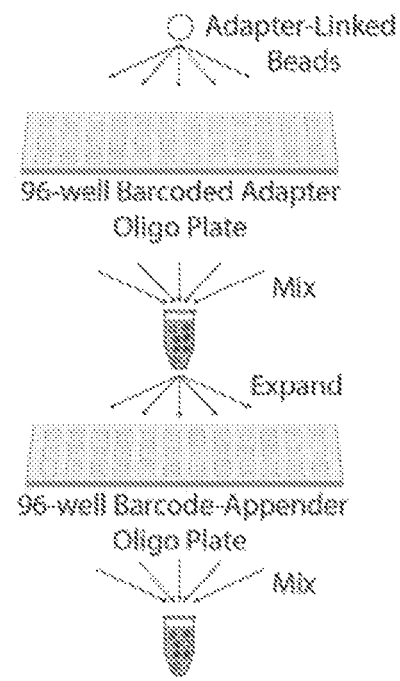
Figures 14A, 14B:
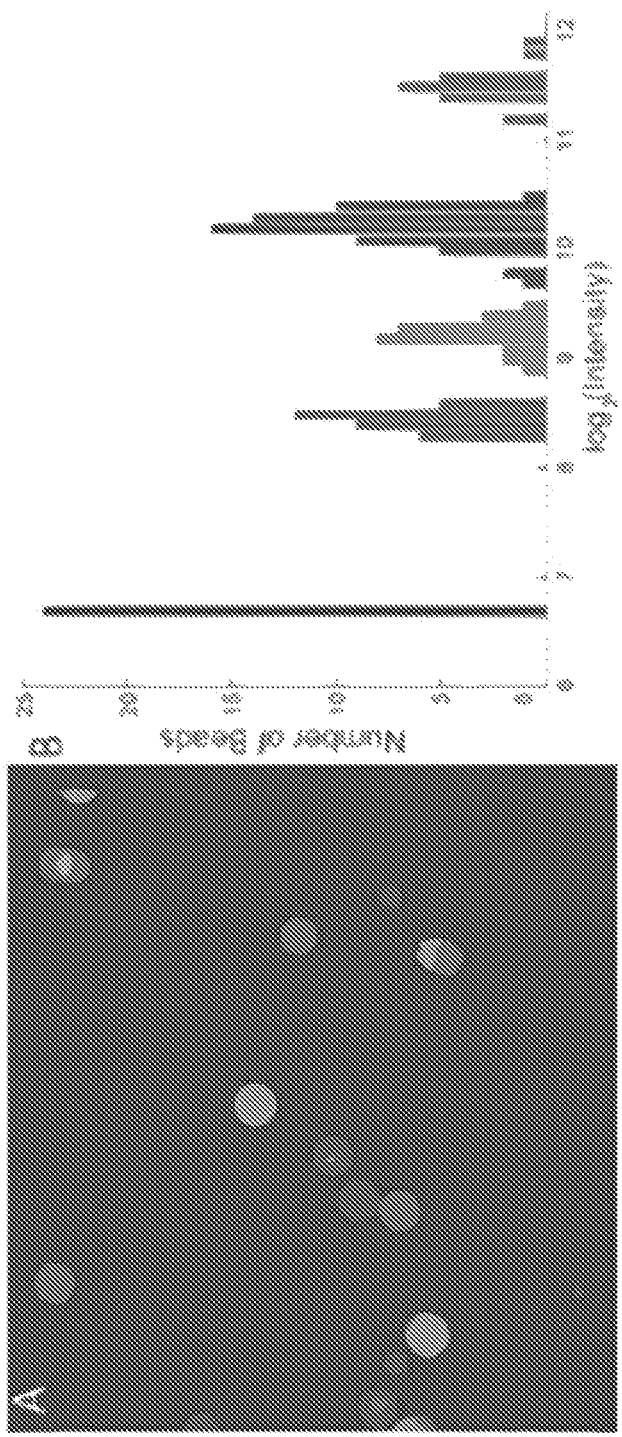
FIGS. 14A and 14B provides for (FIG. 14A) a fluorescence image of beads with different fluorescent colors generated by combinatorial mixing of different fluorescent dyes at different concentrations. Each color combination and intensity represents a different sequence barcode for mRNA capture that is also attached to the bead. In this example the optical barcodes themselves are not sequences.

FIG. 8A shows a pathway analysis of gene ontologies enriched across >11,600 genes that were both detected across our 396 single cell profiles and available in the iPAGE database and ranked based on differential expression in Experiment 1. See, for example, Goodarzi H, Elemento O, Tavazoie S: Revealing global regulatory perturbations across human cancers. *Mol Cell* 2009, 36(5):900-911, which is herein incorporated by reference in its entirety. A matrix of Spearman correlation coefficients across our 396 profiles based on rank-ordering the 189 differentially expressed genes in each cell was then generated. The data was clustered spatially using the t-stochastic neighborhood embedding (t-SNE) algorithm, described for example in Van der Maaten L, Hinton G: Visualizing data using t-SNE. *Journal of Machine Learning Research* 2008, 9(2579-2605):85, a clustering algorithm applied to high-dimensional single cell analysis data (FIG. 8B and FIG. 8C). This t-SNE result contains two closely associated clusters of individual cells.

To understand the origin of these two clusters, the t-SNE clustering with two different color-schemes are displayed. In FIG. 8B, it is shown how single cell profiles from the various lanes of a device described herein are distributed. One of the two clusters contains all of the cells from the MCF10a-exclusive lane, while the other contains nearly all of the cells from the U87 lane with a few exceptions. Single cell profiles from the mixed lanes are distributed throughout the two clusters. While the single cell profiles from mixed lanes are distributed uniformly throughout the MFC10a cluster, there is some separation between a subset of mixed lane profiles and the U87-exclusive lane profiles in the U87 cluster. In FIG. 8C, the same clustering result with a different color scheme that indicates the relative rank ordering of the U87 vs. MCF10a gene sets in each profile is described. This metric associates the cells in each of the two clusters with the expected cell type-specific expression pattern.

In an aspect, the microfluidic platforms described throughout are compatible with transcriptome-wide analysis of individual cells by RNA-Seq. In an another aspect, either could be combined with a sequence-based barcoding scheme to generate a pooled cDNA library from hundreds or thousands of individual cells. For example, in the bead capture device, barcoding is not strictly necessary because physical means could be used to extract the beads from the microwells for downstream processing with conventional labware. Alternatively, fluorescently labeled oligonucleotide probes could be used to image captured RNA molecules similar to RNA-FISH. Probes could be introduced sequentially, imaged, and removed in cycles or combined with previously reported multiplexing schemes. Similarly, sequential rounds of qRT-PCR in sealed microwells could allow targeted detection of specific genes or mutations in captured RNA.

Synthesis of Dual-Barcoded mRNA Capture Beads

In another aspect, dual-barcoded mRNA capture beads were synthesized by the work flow shown in FIG. 15A. Sequence-barcoded mRNA capture beads (MACOSKO-2011-10, ChemGenes) are thoroughly washed with water to remove free-floating oligonucleotides and then immediately evenly distributed into 64 wells on a 96 well plate. The 96 well plate is then sealed, vortexed, and sonicated. In doing so, a small amount of sequence-barcoded mRNA capture oligonucleotides fall off from the beads (bead-free DNA) and get released into the liquid phase. The supernatant from each well (contains bead-free DNA) are collected into separate tubes, converted into double stranded DNA, PCR amplified and indexed, pooled, gel purified, and sequenced (bead-free DNA sequencing data). A unique combination of short oligonucleotides selected from a first set of 6 types of short oligonucleotides and ligation reaction mixture are sequentially added into each of the 64 wells. This results in the attachment of a unique and known combination of oligonucleotides to the beads in each well (FIG. 15B). The sequencing barcode sequence of beads in each well can be obtained from the bead-free DNA sequencing data. Thus, a two-column look-up table (FIG. 15C) is generated where each row represents a bead, one column contains sequencing barcode sequence, and the other column contains a 6-digit optical barcode sequence. The beads are then pooled together and subjected to a second round of split-and-pool synthesis with a different set of 6 types of short oligonucleotides. This generates another two-column look-up table. Each bead appears once in each of the two look-up tables and has a 12-digit binary optical barcode sequence. A total of 4096 types of optically barcoded beads are made. To prevent these newly ligated oligonucleotides from interfering the single-cell RNA-seq library prep steps, a polyethylene glycol (PEG) chain is inserted in the short oligonucleotide.

It was initially attempted to optically barcode the beads spectrally (i.e., labeling the beads with varying amount of dyes with different emission wavelength). The challenge of this approach is that the emission wavelength of commercially available dyes is rather broad. Only a few distinct dyes can fit on the full spectrum of light thus limiting the barcoding capacity. We then tried to barcoding beads with a combination of short oligonucleotides with different sequences. Attachment methods involving use of DNA polymerase may not work.

Demultiplexing Work Flow 12 rounds of sequential fluorescent in situ hybridization (FISH) were used to read out the 12-digit binary optical barcode sequence. Each round of FISH has four major steps including background scan, probe hybridization (150 nM probes), probe scan, and probe stripping (150 mM NaOH). Here the probes used in each round are fluorophore-labeled short oligonucleotides whose sequences are complementary to each of the 12 short oligonucleotides that was ligated to the beads during bead synthesis step. During each FISH round, two populations of beads were detected in terms of fluorescent intensity in the fluorophore channel. Beads in the population that has a higher and lower intensity are assigned a binary sequence of 1 and 0 respectively. After the full 12 rounds of FISH, a 12-digit binary optical sequence is generated for each bead. FIG. 16A shows representative images from optical phenotyping of cells and from optical demultiplexing of beads. FIG. 16B is a histogram of bead intensity after each of the 12 rounds of probe hybridization. FIG. 16C is histogram of optical barcode sequence occurrences.

Instrumentation for Automated Optical Demultiplexing

An automated reagent delivery and scanning system (FIG. 17A) was built for automated on-chip optical demultiplexing (FIG. 17B). The design is illustrated in FIG. 17A. In the automated reagent delivery system, fixed positive pressure was used to drive fluid flow, multichannel rotary selector valves located at the upstream of the microwell array device were used to toggle between different reagent channels, and a solenoid valve located at the downstream of the microwell array device was used to control the on/off of the reagent flow. The microwell array device is thus constantly being pressurized during incubation steps which help prevent the device from drying and suppress bubble formation. A microfluidic flow cell which traps bubbles came from upstream is connected in-serial immediate upstream of the microwell array device to further prevent bubbles from entering the microwell array device. A water hammer arrestor consists of a half-filled cryotube was connected immediate downstream of the microwell array device and upstream of the on-off flow switch valve to buffer the hydraulic shock produced by the on-off switch valve which can cause bead loss. The automated scanning system consists of laser light source, motorized stage, shuttle, and filter wheel, an inverted microscope, and a camera. An optically transparent mechanical support (glass slide) was attached to the bottom surface of the microwell array device to prevent sagging which facilitates imaging. Both the reagent delivery system and the scanning system are controlled by a C++ program.

Full Single-Cell RNA Sequencing and Imaging Work Flow

An an embodiment, full single-cell RNA sequencing and imaging work flow may be as follows. A microwell array device is filled and flushed with TBS buffer. Single-cell suspension is then loaded into the device. The device is scanned under a microscope to obtain imaging phenotype and location of each individual cell in the device. Optically barcoded mRNA capture beads are then loaded into the device. Lysis buffer and oil are flowed into the device sequentially to trigger cell lysis and physically isolate the microwells from each other allowing mRNA from cells in different microwells to be captured by their respective co-localized beads. After the mRNA capture step, captured mRNA molecules are reverse transcribed which coverts mRNA into double-stranded DNA-RNA duplex resulting in the barcoding of cDNA. Any unused single-stranded capture primers on bead surface are removed by exonuclease I digestion. The device is then subject to twelve rounds of sequential FISH to read out the optical barcode sequence of each bead and their locations in the device. So far, all the reactions including cell lysis, mRNA capture, reverse transcription, exonuclease I digestion, and optical demultiplexing are performed on the device which allows the linking between each cell's imaging phenotype and optical barcode sequence of the bead that resides in the same well with the cell. After the optical demultiplexing step, all beads are extracted from the device. Tube-based PCR reactions are used to pre-amplify bead-bound cDNA molecules. In the case where the number of cells in the device is greater than the optical barcoding capacity enabled by the current 4096 unique optical sequences, the microwell array is cut into multiple pieces before the beads were extracted and processed in separate tubes in parallel. Each piece contains a number of cells within the optical barcoding capacity of the current 4096 unique optical sequences. By doing so, the optical barcoding capacity gains a n fold increase where n is the number of pieces the full device is cut into. The amplified cDNA copies are released into the liquid phase and further amplified into sequencing library and sequenced by commercially-available kit (Nextera XT, Illumina) and sequencers (NextSeq, Illumina). The raw fastq files generated by sequencers are processed to generate a digital expression matrix where each column represents the expression profile of a cell and each row represents the expression level of a gene. The look-up table generated in the bead synthesis step are then used to further link each cell's imaging phenotype to sequencing barcode sequence of the bead that resided in the same well with the cell and the associated mRNA expression profile.

Mixed Species

Performance of the technique was evaluated by an experiment using two cell lines of distinct species (human U87 and mouse 3T3). Each of the two cell lines were stained with a dye with different emission wavelength. The two cell lines were then mixed in approximately equal proportion and loaded into a microwell array device followed by the full work flow described above. The imaging phenotypes obtained in this experiment include live stain intensity, cell size and morphology.

Sequencing Data Quality

FIGS. 18A-E show sequencing data quality based on two major metrics for single-cell sequencing data quality: purity and molecular capture efficiency. In the mixed species experiment on human U87 and mouse 3T3, an average purity of 98% was observed, and an average molecular capture efficiency of 2452 genes/6224 molecules was detected per cell.

Linking Accuracy

Since the two cell lines are from different species (human and mouse) that have different genomes, the species identity of each cell was determined based on the genome that majority of its mRNA molecules was mapped to. In addition, cells from different species were live stained with different dyes. Therefore, the species identity of each cell was independently determined based on the imaging data. The linking accuracy is defined as the percentage of cells having consistent species calls based on both sequencing and imaging data. A linking accuracy of 90% was demonstrated in this initial proof-of-concept experiment.

Single-Stranded Ligation and Detached Oligonucleotides

Optically barcoded mRNA capture beads are generated by modifying sequence barcoded mRNA capture beads. These beads contain oligonucleotides with a universal primer sequence on the 5'-end, barcode sequences in the middle, and oligo(dT) on the 3'-end for mRNA capture. DNA-replicating enzymes, such as DNA polymerase, are used to attach the optical barcode oligonucleotides to the 3'-end of a subset of mRNA capture oligos on the beads. In addition, DNA-replicating enzymes, such as DNA polymerase, are used to generate sequencing libraries for identifying the barcode sequences attached to each bead. Exposure of the mRNA capture beads to enzymes that replicate DNA in a template-directed fashion prior to conducting single-cell RNA-Seq may be disadvantageous. This may be due to these enzymes causing mRNA capture oligonucleotides and optical barcode oligonucleotides to serve as primers and templates for each other, generating "primer-dimers" on the surface of the beads. This may reduce the concentration of mRNA capture oligonucleotides on the bead that is available for hybridization to mRNA and cDNA synthesis in single-cell RNA-Seq.

In an aspect, the potential problems noted above may be resolved by avoiding exposure of the beads to DNA-replicating enzymes when modifying the oligonucleotides on the bead and generating sequencing libraries for identifying the barcode sequences on each bead. In this aspect, a single-stranded ligation reaction facilitated by a DNA ligase, rather than primer extension facilitated by DNA polymerase is used to attach the optical barcode oligonucleotides to a subset of mRNA capture oligonucleotides on the bead.

In an aspect, sequencing libraries containing the barcode sequences of each bead are generated by taking advantage of the fact that a small number of oligonucleotides detach from the beads at a slow rate, making them available in solution. By allowing this to occur and isolating these detached oligonucleotides from the supernatant of the beads, a sequencing library using DNA polymerase can be generated, but without exposing the beads directly to this enzyme.

Single-stranded ligation and use of detached oligonucleotides permit synthesis of optically barcoded mRNA capture beads, decoding of the barcode sequences, and efficient single-cell RNA-Seq using those beads.

The challenge noted above could be applicable to other areas. While the mRNA capture beads modified with optical barcode sequences, it may be desireable to modify the mRNA capture beads for applications such as targeted capture of specific gene sequences. For example, one could envision modifying a subset of oligonucleotides on the mRNA capture beads using the methods described above to facilitate targeted enrichment of a specific gene sequence from individual cells while still allowing unbiased profiling of the mRNA from those cells using the remaining oligo(dT) capture sequence. Specific cases include targeted enrichment of the T cell receptor repertoire or antibody repertoire from immune populations with simultaneous, unbiased mRNA profiling of the same individual cells.

Kits

In another aspect, the disclosure provides for a kit comprising, consisting essentially of, or consisting of any of probes, beads, and regents disclosed herein. In an aspect, the kit includes any of the combination of probes, beads, and regents disclosed in the Figures herein. In another aspect, the kit provides for probes, beads, and regents applied in a manner that is consistent with the methodology of the examples and figures. In another aspect, the kit provides instructions or guidance regarding the use of the compositions, probes, devices, systems or methods described herein.

In an aspect, the kit includes instructions describing the methodology described herein.

The following examples serve to illustrate certain aspects of the disclosure and are not intended to limit the disclosure.

EXAMPLES

The invention is illustrated herein by the experiments described by the following examples, which should not be construed as limiting. The contents of all references, pending patent applications and published patents, cited throughout this application are hereby expressly incorporated by reference. Those skilled in the art will understand that this invention may be embodied in many different forms and should not be construed as limited to the embodiments set forth herein. Rather, these embodiments are provided so that this disclosure will fully convey the invention to those skilled in the art. Many modifications and other embodiments of the invention will come to mind in one skilled in the art to which this invention pertains having the benefit of the teachings presented in the foregoing description. Although specific terms are employed, they are used as in the art unless otherwise indicated.

Example 1

Generation of Optically Barcoded mRNA Capture Beads for Optical Demultiplexing by Multi-Color Fluorescence Imaging for Single Cell RNA-Seq N-succinimide-coated Sepharose beads with a mean diameter of ~30 μm were obtained from GE Healthcare in isopropanol. The beads were washed three times with water by centrifugation and split into 125 different tubes. The beads were then re-suspended in a reaction mixture with a final concentration of 100 mM sodium borate (pH 8.5) along with three differently-labeled streptavidin proteins (streptavidin-AlexaFluor 488, streptavidin-AlexaFluor 546, and Streptavidin-AlexaFluor 647 from Life Technologies). For each of the 125 reaction mixtures, the three proteins were added at one of 5 concentrations such that each of the 125 reaction mixtures had one of $5^3=125$ unique combinations of labels and label intensities. The reaction was incubated at room temperature for one hour on a rotisserie to allow the labeled streptavidins to covalently react with the beads, form amide bonds. The beads were then washed five times in 50 mM Tris-HCl pH 8, 50 mM NaCl, and 0.1% Tween-20 before using to completely quench any remaining reactive groups on the beads. Each of the 125 uniquely labeled sets of beads were then incubated with a uniquely barcoded, 5'-biotinylated oligonucleotide. The oligonucleotides had a universal adapter sequence on the 5'-end to facilitate amplification, a barcode sequence, and oligo(dT) on the 3'-end to facilitate mRNA capture. The oligonucleotides became bound to the beads through the biotin-streptavidin interaction, resulting in beads that could be identified by fluorescence microscopy based on their unique configuration of fluorescent labels to harbor a specific nucleic acid barcode sequence.

Generation of Optically Barcoded mRNA Capture Beads for Optical Demultiplexing by Sequential Fluorescence Hybridization for Single Cell RNA-Seq 2.4 million beads aminated polystyrene beads (Custom Primer Support 200 Amino, GE) were reacted with an 8% solution of glutaraldehyde in Cyanoborohydride Coupling Buffer (Sigma) for six hours a room temperature. After washing the beads in phosphate buffered saline (PBS), the beads were divided evenly into each of 32 tubes. To each tube, 62.5 pmol of a unique 5'-aminated oligonucleotide were added containing an adapter sequence, a unique capture barcode sequence, and a linker sequence. In addition, zero or more 5'-aminated oligonucleotides were added from a set of five, each of which contains a unique optical barcode sequence and a linker sequence. The constellation of oligonucleotides on the bead surface forms a binary code. For example, if there are five oligonucleotides in a set, and the first, third, and fourth oligonucleotides are present on the bead, then the code could be in an aspect, 10110. However, there will also be a bead in the set with the code 00000, where none of the oligonucleotides are present. This also provides a signal, a bead that does not fluoresce when exposed to any of the probes 2.5 pmol of each optical barcode oligonucleotide was further added. Each capture barcode sequence is associated with a unique set of optical barcode sequences. In this embodiment, there are 32 capture barcode sequences and $2^5=32$ possible combinations of optical barcode configurations added in the first round of synthesis. The 5'-aminated oligonucleotides were reacted with the aldehyde-conjugated beads in Cyanoborohydride Coupling buffer for 12 hours at room temperature. The reaction was then quenched by the reaction by adding 1 M Tris-HCl to each well. The beads were then washed in PBS.

In a second barcode synthesis, the 32 reactions from the first round were pooled and then re-distributed into each of 128 tubes. To each tube, 150 pmol of a unique oligonucleotide was added containing a linker sequence complementary to that in the capture barcode oligonucleotides already attached to the beads, a second capture barcode sequence, a random sequence (for unique molecular identification), and a poly(A) sequence. In addition, zero or more oligonucleotides from a set of seven were added, each of which contains a unique optical barcode sequence and a linker sequence complementary to that in the optical barcode oligonucleotides already attached to the beads. 20 pmol of each optical barcode oligonucleotide. Each capture barcode sequence is associated with a unique set of optical barcode sequences. There are 128 capture barcode sequences and $2^7=128$ possible combinations of optical barcode configurations added in the second round of synthesis. In combination with the first round of synthesis, the second round of synthesis results in a set of 32×128=4,096 uniquely barcoded beads with both unique capture and optical barcodes attached. The second round oligonucleotides was hybridized to the oligonucleotides attached in the first round in Buffer 2 (New England BioLabs) with 1% tween-20 (Sigma) at 50 C for 20 minutes and at room temperature for 12 hours. The beads were then washed and then copied the second round oligonucleotides onto the 3'-end of the first round oligonucleotides by primer extension with Klenow Large Fragment DNA Polymerase (New England BioLabs) at room temperature for 2 hours. The primer extension reaction was quenched with EDTA followed by sodium hydroxide. The beads from all 128 reactions were then pooled and washed them extensively in sodium hydroxide and Wash Buffer (10 mM Tris pH 8, 1 mM EDTA, 0.01% tween-20).

Fabrication of a PDMS Microwell Array Device

Microfabricated arrays of cylindrical pillars in photoresist on a silicon wafer were obtained from FlowJEM. The pillars were 50 microns in diameter and 50 microns tall. A second wafer contained a relief pattern of a flow channel. A 1:10 mixture of liquid polydimethylsiloxane (PDMS) base and curing agent (Sylgard 184, Dow-Corning) was poured on each wafer. A glass microscope slide was pressed onto the uncured liquid PDMS that had been poured on the wafer containing cylindrical pillars, forming a thin layer of PDMS between the wafer and the glass slide. Both wafers with liquid PDMS were then placed in an oven to cure at 90° C. overnight. The cured, solidified PDMS were then peeled from both wafers resulting in a thin microwell array on the glass slide and a PDMS flow channel. After using a punch to insert inlet and outlet holes on either end of the flow channel, air plasma was used to bond the flow channel over the microwell array. The resulting microwell array flow cell device was then used for single cell RNA-Seq and optical demultiplexing.

Single Cell RNA-Seq Library Generation in a Microwell Array Device Using In Vitro Transcription Prior to the experiment, the device was flushed with 0.1% Tween-20 and incubated for several hours to hydrate the microwells, which were subsequently washed with PBS. Cell suspensions were counted using the Countess automated cell counter (Life Technologies). A suspension of cells in PBS mixed with Calcein AM (live stain) was flowed into the device and incubated for five minutes. Cells were deposited in the microwells by gravity. After thoroughly removing any excess cells with PBS, a suspension of barcoded capture beads that had been pre-counted by microscopy was introduced in PBS and allowed to load under gravity for five minutes. Excess beads were thoroughly removed with PBS and the flow cell was incubated on ice. A lysis buffer containing 0.08% Triton X-100 supplemented with SUPERaseIN (Life Technologies) was flowed under ice-cold conditions immediately followed by fluorinert oil (Sigma) to seal the device. After two cycles of freeze-thaw at −80 C to enhance cell lysis, the device was incubated at room temperature for 60 minutes for mRNA capture. After one hour of incubation for mRNA capture, the device was unsealed by rapid removal of the fluorinert oil with 20 mM Tris-HCl pH 8 containing 1% Triton X-100 and SUPERaseIN followed by thorough washing of the device with 20 mM Tris-HCl pH 8, 50 mM NaCl, and 0.1% Tween-20.

The mRNA captured on the beads was reverse transcribed using ProtoScript II Reverse Transcriptase (New England BioLabs) for two hours at 42 C in 1× ProtoScript Reverse Transcriptase Buffer supplemented with 10 mM DTT, 0.5 mM dNTPs, 0.1% Tween-20, and SUPERaseIN. The reaction mixture was then removed with 20 mM Tris-HCl pH 8, 50 mM NaCl, and 0.1% Tween-20. Second strand synthesis was carried out using the MessageAmp II aRNA amplification kit (Ambion) according to the manufacturer's instructions. This involves a reaction mixture with DNA polymerase and RNaseH that is incubated for two hours at 16 C. After removing the second strand reaction mixture with 20 mM Tris-HCl pH 8, 50 mM NaCl, and 0.1% Tween-20, in vitro transcription (IVT) was carried out using reagents in the MessageAmp II aRNA amplification kit (Ambion) including T7 RNA polymerase according to the manufacturer's instructions for 13 hours at 37 C. The reaction linearly amplified the double-stranded cDNA libraries on the beads, eluting pools of barcoded aRNA into the flow channel which was subsequently removed using a pipette and purified using an RNA Clean & Concentrator Column (Zymo).

aRNA was then reverse transcribed using uniquely barcoded random hexamer primers using PrimeScript Reverse Transcriptase (Clontech) supplemented with 0.5 mM dNTPs, 10 mM DTT, 1× PrimeScript Buffer, and 0.1 U/uL SUPERaseIN. The reaction proceeded for 10 minutes at 25° C. and two hours at 42° C. The RNA-cDNA hybrid product was purified twice using 0.65×Ampure XP beads (Beckman). The resulting cDNA libraries were then enriched by PCR using Phusion High Fidelity DNA polymerase (New England BioLabs) using the Illumina RP1 and RPI primers. The resulting PCR product was then purified on a 1.5% agarose gel, extracted using a Gel Extraction Kit (Qiagen), purified using 0.65× Ampure XP beads (Beckman), and sequenced on a NextSeq 500 sequencer (Illumina).

Single Cell RNA-Seq Library Generation in a Microwell Array Device Using Template-Switching Cells and mRNA capture beads were loaded into the microwell array device as described above. The device was then placed on a computerized temperature and fluidic control system for automated single cell library production. The system consists of a manually controlled pressurization system, software, an electronic six-port rotary selector valve (Rheodyne), and a thermoelectric heater-cooler module (TE Technology). After cooling the system to 4 C, a lysis solution comprised of TCL Buffer (Qiagen) and 1% 2-mercaptoethanol was introduced to the device, which was rapidly and automatically sealed with fluorinert (Sigma). After removing the oil and unsealing the microwells, a reverse transcription reaction mixture comprised of 1× Maxima RT Buffer, 1 mM dNTPs, 1 U/uL SUPERaseIN, 2.5 uM template-switching oligonucleotide, 0.1% Tween-20, and 10 U/uL Maxima H-Reverse Transcriptase (ThermoFisher) was introduced and incubated for 30 minutes at room temperature followed by 90 minutes at 42 C.

After removing the reverse transcription reaction mixture, the beads were removed from the microwells by sonication, concentrated by centrifugation and incubated for 30 minutes at 37 C with Exonuclease I in 1× Exonuclease I Buffer (New England BioLabs). The beads were then washed in 10 mM Tris-HCl pH 8, 1 mM EDTA, and 0.5% sodium dodecyl sulfate (SDS) followed by 10 mM Tris-HCl pH 8, 1 mM EDTA, and 0.01% Tween-20. The beads were then re-suspended in a PCR reaction mixture containing 1× HiFi Hot Start Ready Mix (Kappa) and 1 uM PCR primer and thermocycled to amplify a full-length, double-stranded, pooled cDNA library. The PCR product was purified with 0.6× Ampure XP beads (Beckman). The library was then fragmented and a sequencing adapter introduced using the Nextera XT library preparation kit (Illumina) according to the manufacturer's instructions. Finally, the sequencing library was enriched by PCR using a reverse PCR primer from the Nextera XT kit and a custom forward PCR primer along with amplification reagents from the Nextera XT kit used according to the manufacturer's instructions. The resulting PCR product was purified with 0.6× Ampure XP beads (Beckman) and sequenced on a NextSeq 500 sequencer (Illumina).

Optical Demultiplexing of Barcoded mRNA Capture Beads

Figure 1B:
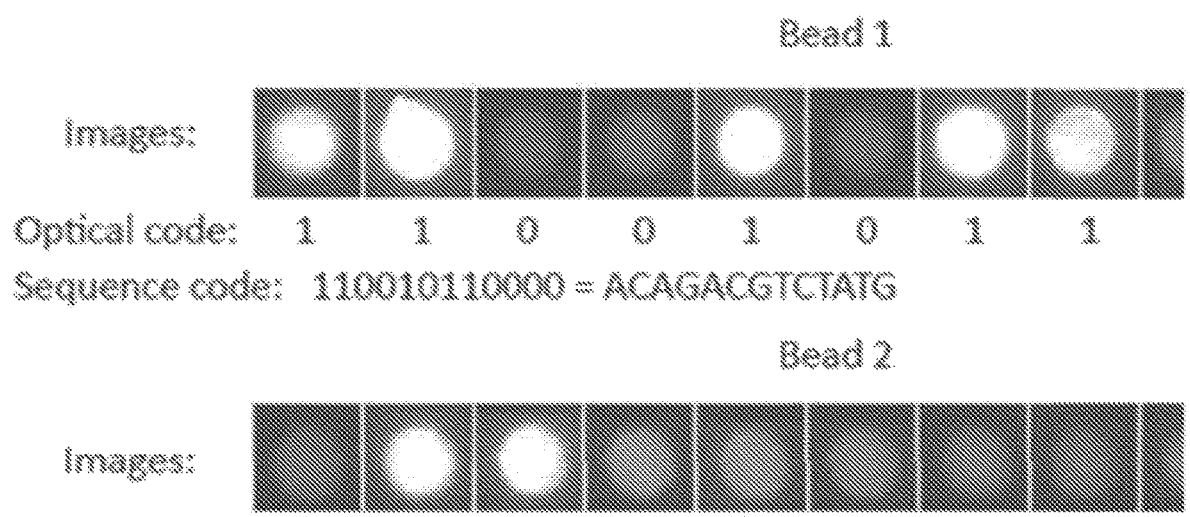
FIG. 1B provides for a series of 12 fluorescence images from each of two beads in the microwell array device after introduction of each of 12 barcoded probes. When a probe is complimentary to optical barcode oligonucleotides on the bead surface, the bead becomes fluorescent, resulting in the 12-digit binary code that corresponds to a sequence attached to the capture oligonucleotides on the bead.

Following cDNA synthesis on the surface of optically barcoded capture beads, the microwell array device was transferred to an epifluorescence microscope system. The microscope system contains an inverted microscope frame (Ti-U, Nikon), an electron-multiplied charge coupled device (EM-CCD) camera (iXon, Andor), a 20× 0.75 NA air objective lens (Nikon), a three-axis motorized stage (ASI), a 140 mW 637 nm optically pumped semiconductor laser (OBIS, Coherent), and custom optics for coupling the laser beam into the microscope. The custom optical path includes an engineered diffusor (Thorlabs) and electronic phase scrambling device for flattening the illumination field. An automated, computer-controlled fluidics system is attached the microscope system and contains two, ten-channel rotary selector valves (Rheodyne). A single computer program controls the fluidics system, laser shutter, camera, and microscope stage. Each of twelve, Cy5-labeled optical barcode probes was loaded into the channels of the fluidics system. The optical barcode probes were each complementary to one of the optical barcode oligonucleotides attached the beads as described above. In addition, a wash buffer (20 mM Tris-HCl pH 8, 50 mM NaCl, and 0.1% Tween-20) and a denaturing solution (100 mM NaOH) were loaded into independent channels of the fluidics system. The first of twelve optical barcode probes was flowed into the flow cell, incubated at room temperature for ten minutes, and washed out with wash buffer. After washing, the microscope automatically scanned and imaged the entire microwell array and identifies the beads in each microwell that are fluorescently labeled with the first optical barcode probe by hybridization, indicating the presence of the first optical barcode sequence. The denaturing solution was then introduced to the flow cell which causes the first optical barcode probe to dissociate from the beads and exit the flow cell. After washing with wash buffer, the process was repeated for all of the remaining optical barcode probes. At conclusion, the configuration of optical barcode sequences attached to each bead can be inferred from the series of twelve fluorescence images. Because each unique configuration of optical barcode sequences corresponds to a specific capture barcode sequence associated with the cDNA that is also attached to each bead, the capture barcode sequence for each individual cell can be identified (see, for example, FIG. 1A and FIG. 1B). This allows a direct association between imaging information acquired from the cells, the capture barcode associated with the cDNA of the at cell that is read out on the sequencer, and therefore the transcriptome of that cell all through identification of the corresponding optical barcode.

Example 2

Fabrication PDMS Microwell Arrays for Single Cell RNA Printing

Silicon wafer masters (~4 in) with cylindrical pillars (diameter 50 micron; height 30 micron) for photolithography were obtained from Stanford Microfluidics Foundry and were subsequently exposed to 1H,1H,2H,2H-perfluorooctyltrichlorosilane (Alfa Aesar) vapor under vacuum for ~30 minutes to avoid curing of the PDMS on the wafer. PDMS (Sylgard 184, Dow Corning) was thoroughly mixed 10:1 (base:curing agent) and degassed under house vacuum for 2 hours. ~15 g of degassed PDMS was poured onto the 4 in silicon wafer master and allowed to cure overnight at ~90° C. This slab with microwells was then gently peeled off from the master and used to construct PDMS microreactor flow cells.

Surface Chemistry on Glass Coverslip

VistaVision Microscope cover glass (22×50×0.16 mm) was plasma sterilized (Harrick Plasma) for ~5 mins, and immediately immersed in 10% acetic acid (pH 3.5) ethanol solution containing 0.5% trimethoxysilanealdehyde (United Chemical Technologies), and incubated for 15 mins. The cover glass was then washed with ethanol, air-dried and heat cured at 90° C. for 10 mins. A 2.5 µM solution of 5'-aminated-LNA-oligo(dT) (Exiqon) in cyanoborohyride coupling buffer (Sigma) supplemented with 1M NaCl was added on the aldehyde surface of the cover glass. The cover glass was incubated for 3 hours at room temperature inside a humid chamber, and then washed with DI water. The aldehyde surface was then incubated in 10% ethanolamine in cyanoborohydride coupling buffer for 30 mins to quench the unreacted aldehydes.

Construction of the Flowcell

A rectangular slab (3.5×1.5×0.1 cm) of PDMS containing the microwell array in the center was cut and a double-sided adhesive tape (~120 micron thickness, Grace BioLabs) was adhered to the flat side of the PDMS slab that contained the microwells. The tape was cut in an elongated hexagonal shape, which formed the microchannel in the flowcell. The other side of the tape was pasted on the LNA coated cover glass to build the microfluidic device. Two holes were punched at the two end of the microchannel with a biopsy punch, which acted as the inlet and outlet of the device and tubing were attached to allow liquid flow. The periphery of the PDMS slab was sealed on to the cover glass using epoxy glue.

Experimental Procedure for Single Cell mRNA Printing on Glass

Figure 2A:
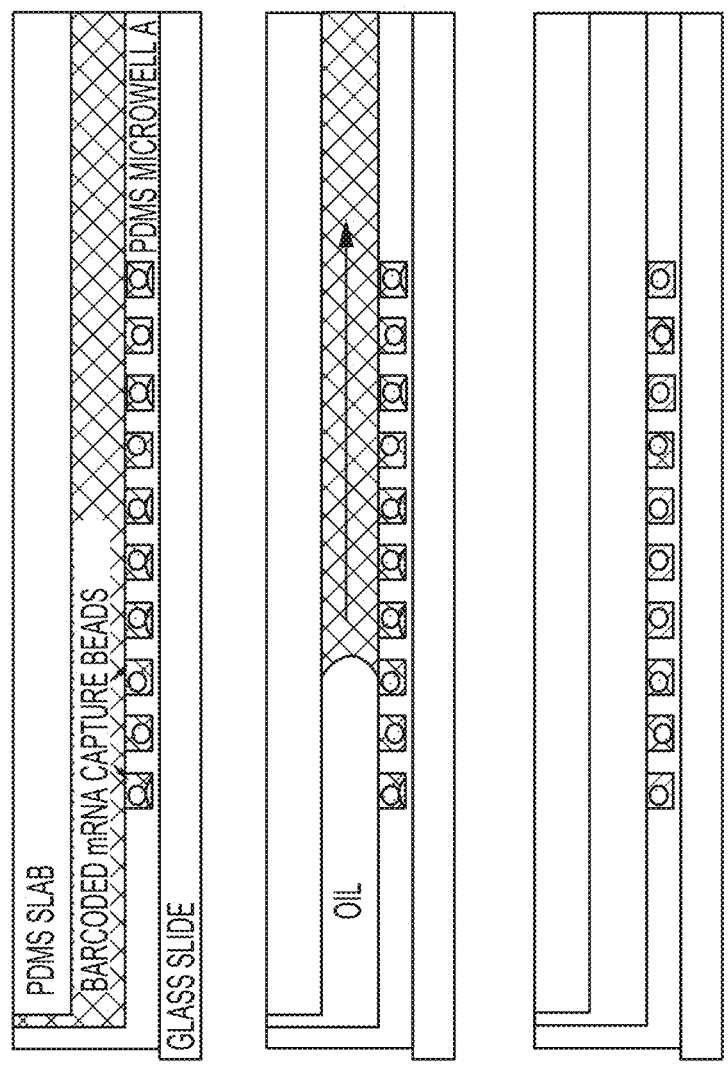
FIG. 2A shows schematic and fluorescence imaging data for single cell RNA capture on beads.

A suspension of U87 cells in PBS was flowed in to the device and loaded into the microwells by gravity (kept upside down) for 5 mins at room temperature. After washing with PBS buffer supplemented with SUPERaseIN (Ambion), the microwells were sealed using an automated mechanical device by placing the flow cell upside down on a screw mounted on a motorized z-stage (ASI) so that the top PDMS slab containing the microwells was pressed against the glass bottom. After sealing the wells mechanically, the seal was retained by hermetic sealing to trap the single cell lysate within a single microwell. The cells were lysed by freeze-thaw. Once the cells lysed, the mRNAs were captured on the LNA surface by hybridization of the 3'-polyA tail of the mRNA to the LNA-oligo(dT) during a 60 minute incubation. The microwells were then unsealed and the flow cell was immediately and vigorously washed with the Wash Buffer (20 mM Tris pH 8.0, 50 mM NaCl, 0.1% Tween-20), supplemented with SUPERaseIN (FIG. 2A). The flowcell was then incubated with TURBO DNase (Ambion) in TURBO DNase buffer, supplemented with 0.1% Tween-20 and SUPERaseIN for 30 mins at 37° C. to digest any residual genomic DNA. The mRNA captured on the LNA surface was reverse transcribed using M-MuLV Reverse Transcriptase (New England Biolabs) for 2 hours at 42° C. in 1× M-MuLV Reverse Transcriptase buffer, supplemented with 10 mM DTT, 5 mM dNTPs, 0.1% Tween-20 and SUPERaseIN. After reverse transcription the double stranded RNA-cDNA hybrids were stained with 10 nM SYTOX Orange dye (Invitrogen), an intercalator that is selective for double-stranded DNA, and incubated for 5 mins prior to imaging.

The epifluorescence imaging system was constructed on an inverted Nikon Eclipse Ti-U microscope with 20×, 0.75 NA air objective (Plan Apo X, Nikon). SYTOX Orange was excited using a 532 nm diode-pumped solid state laser (Dragon Lasers), and the fluorescence was collected and imaged onto an electron multiplying charge coupled device (EMCCD) camera (iXON3, Andor Technologies). The images were acquired with 0.5 s exposure time (controlled by external shutter) at 1 MHz digitization (with no EM gain). Automated scanning of the surface (motorized X-Y stage, ASI), image acquisition, and illumination were controlled with custom software written in C/C++. The images were analyzed using ImageJ software.

Microfluidic Device for Single Cell RNA-Seq

For the single cell RNA-Seq experiment a monolithic PDMS was designated based multi-channel device, by fabricating each channel with a microwell array. Two key soft lithography techniques were used to fabricate this device. First, instead of using silicon wafer master directly for fabricating the microwell array as done in the case of RNA printing device, we generated a secondary master made out of PDMS. This was done because the aspect ratio of the micropillars results in a relatively fragile silicon master. It was found that the PDMS master to be more durable. Second, instead of using a double-sided adhesive tape for the device assembly, the bottom and the top of the device were bonded together by partial curing. This provided us with more durable and reliable partitions between the individual channels of our device than could be generated using tape. For the multi-lane microfluidic device, two different silicon wafer masters were fabricated, one for the top and other for the bottom containing the array of microwells. Masters for soft lithography were generated from 4-inch silicon test wafers (University Wafer) coated with SU-8 2005 (MicroChem) photoresist. The wafer master for the bottom of the device contained five arrays of cylindrical pillars (diameter 50 micron; height 50 micron). The wafer was then fluorosilanized as described above. To avoid repeated use of the silicon wafer, we fabricated secondary masters in PDMS as follows. 40 g of degassed PDMS 10:1 (base:curing agent) was poured and cured on the wafer, and then peeled off and cut into a rectangular slab. The surface containing an array of microwells was oxidized in plasma chamber (Harrick Plasma) for ~2 mins and immediately fluorosilanized. Using this microwell-containing slab as a master, ~10 g of degassed PDMS was cured on it and peeled off. This new PDMS slab containing array of pillars is an exact replica of the silicon wafer, and is fluorosilanized and served as a secondary master for soft lithography for microfabrication of the bottom part of the microfluidic flowcell device. ~2 g of degassed PDMS 10:1 (base:curing agent) was poured on a plasma cleaned glass slide and the secondary master with pillar array was placed gently with pillars immersed into the liquid PDMS. The slide, PDMS and master (on top) was degassed for ~5 mins and then cured hard at 90° C. for 2 hours. After curing, the master is peeled off and a thin layer of PDMS is bonded to the glass slide with 5 lane arrays of microwells.

A second silicon wafer master was constructed containing five longitudinal ridges (with a height of 100 microns) with rounded ends on which ~30 g of degassed PDMS 15:1 (base:curing agent) was poured and allowed to cure partially at 60° C. for 90 mins. The partially cured PDMS was cut into a slab, holes were punched at either end of each channel, and the slab was placed gently on the top of the glass slide containing the microwell array in such a way that the longitudinal grooves were aligned over each of the five microwell arrays. The slide assembly was then incubated at 90° C. overnight to form a single monolithic PDMS structure as shown in FIG. 5A.

Synthesis of Uniquely Barcoded Beads for mRNA Capture

N-succinimide-coated Sepharose beads with a mean diameter of ~30 µm were obtained from GE Healthcare in isopropanol. The beads were washed three times with water by centrifugation and re-suspended in a reaction mixture with a final concentration of 100 mM sodium borate (pH 8.5) and ~0.8 mg/mL streptavidin (streptavidin from New England BioLabs was spiked with ~2% AlexaFluor 647-labeled streptavidin from Life Technologies). The reaction was incubated at room temperature for one hour on a rotisserie to allow the streptavidin to covalently attach to the beads. The beads were then washed five times in Wash Buffer and incubated in 1 Wash Buffer for 30 minutes before using to completely quench any remaining reactive groups on the beads.

A dual-biotinylated oligonucleotide containing both the T7 promoter sequence and a partial Illumina adapter sequence (Table 1) were annealed to each of 96 oligonucleotides (Table 2) that are complementary to the partial Illumina adapter sequence on the 3'-end and contain a unique barcode and universal anchor sequence on the 5'-end (FIGS. 3A and 3B). Table 1 describes a list of oligonucleotides used for barcoding and library preparation in additional to list of cell-identifying barcodes in Table 2 for Experiment 1.

TABLE 1

| Oligonucleotide Name | Oligonucleotide Sequence | SEQ ID NO: |
|---|---|---|
| Bead Capture Oligo (5'-dual biotinylated) | AGGTAAGGTAATACGACTCACTATAGGG GTTCAGAGTTCTACAGTCCGACGATC | 9464 |
| RT1 (Reverse Transcription Primer for Lane 1) | GCCTTGGCACCCGAGAATTCCANNNNNN NNCGTGATNNNNNN | 9465 |
| RT2 (Reverse Transcription Primer for Lane 2) | GCCTTGGCACCCGAGAATTCCANNNNNN NNACATCGNNNNNN | 9466 |
| RT3 (Reverse Transcription Primer for Lane 3) | GCCTTGGCACCCGAGAATTCCANNNNNN NNGCCTAANNNNNN | 9467 |
| RT4 (Reverse Transcription Primer for Lane 4) | GCCTTGGCACCCGAGAATTCCANNNNNN NNTGGTCANNNNNN | 9468 |
| RT5 (Reverse Transcription Primer for Lane 5) | GCCTTGGCACCCGAGAATTCCANNNNNN NNCACTGTNNNNNN | 9469 |
| RP1 (PCR Primer 1) | AATGATACGGCGACCACCGAGATCTACA CGTTCAGAGTTCTACAGTCCGA | 9470 |
| RPI1 (PCR Primer 2) | CAAGCAGAAGACGGCATACGAGATCGTG ATGTGACTGGAGTTCCTTGGCACCCGAG AATTCCA | 9471 |

TABLE 2

| Oligonucleotide Name | Oligonucleotide Sequence | SEQ ID NO: |
|---|---|---|
| FBC_Oligo1 | CAGGTCAACCAGAGAGATCGTCGGACTGTAGAACTCTGAAC | 9472 |
| FBC_Oligo2 | CAGGTCAAAGTACGCGATCGTCGGACTGTAGAACTCTGAAC | 9473 |
| FBC_Oligo3 | CAGGTCGTTTGGCATGATCGTCGGACTGTAGAACTCTGAAC | 9474 |
| FBC_Oligo4 | CAGGTCAAGTGAGGTGATCGTCGGACTGTAGAACTCTGAAC | 9475 |
| FBC_Oligo5 | CAGGTCACGTTAGCTGATCGTCGGACTGTAGAACTCTGAAC | 9476 |
| FBC_Oligo6 | CAGGTCGTGCTAGAGGATCGTCGGACTGTAGAACTCTGAAC | 9477 |
| FBC_Oligo7 | CAGGTCGTCCTGTGTGATCGTCGGACTGTAGAACTCTGAAC | 9478 |
| FBC_Oligo8 | CAGGTCTCTACGGCAGATCGTCGGACTGTAGAACTCTGAAC | 9479 |
| FBC_Oligo9 | CAGGTCACAGGGCTTGATCGTCGGACTGTAGAACTCTGAAC | 9480 |
| FBC_Oligo10 | CAGGTCGTGCGTTATGATCGTCGGACTGTAGAACTCTGAAC | 9481 |
| FBC_Oligo11 | CAGGTCGGGTAAGTAGATCGTCGGACTGTAGAACTCTGAAC | 9482 |
| FBC_Oligo12 | CAGGTCTCCCTTAGGGATCGTCGGACTGTAGAACTCTGAAC | 9483 |
| FBC_Oligo13 | CAGGTCCAAGTTGGTGATCGTCGGACTGTAGAACTCTGAAC | 9484 |
| FBC_Oligo14 | CAGGTCTTCTCACTCGATCGTCGGACTGTAGAACTCTGAAC | 9485 |
| FBC_Oligo15 | CAGGTCTCCCACTCTGATCGTCGGACTGTAGAACTCTGAAC | 9486 |
| FBC_Oligo16 | CAGGTCCGGTATACCGATCGTCGGACTGTAGAACTCTGAAC | 9487 |
| FBC_Oligo17 | CAGGTCAGGCATGTGGATCGTCGGACTGTAGAACTCTGAAC | 9488 |
| FBC_Oligo18 | CAGGTCCCCAGATTGGATCGTCGGACTGTAGAACTCTGAAC | 9489 |
| FBC_Oligo19 | CAGGTCTTCCCTTGAGATCGTCGGACTGTAGAACTCTGAAC | 9490 |
| FBC_Oligo20 | CAGGTCGTTGTACGAGATCGTCGGACTGTAGAACTCTGAAC | 9491 |
| FBC_Oligo21 | CAGGTCTGCTTGCAGGATCGTCGGACTGTAGAACTCTGAAC | 9492 |
| FBC_Oligo22 | CAGGTCGGCCTCATTGATCGTCGGACTGTAGAACTCTGAAC | 9493 |
| FBC_Oligo23 | CAGGTCAACAGCCTAGATCGTCGGACTGTAGAACTCTGAAC | 9494 |
| FBC_Oligo24 | CAGGTCGATGCAATGGATCGTCGGACTGTAGAACTCTGAAC | 9495 |
| FBC_Oligo25 | CAGGTCGAAGGAACGGATCGTCGGACTGTAGAACTCTGAAC | 9496 |
| FBC_Oligo26 | CAGGTCCAGCCACTTGATCGTCGGACTGTAGAACTCTGAAC | 9497 |
| FBC_Oligo27 | CAGGTCCTCTGCTTCGATCGTCGGACTGTAGAACTCTGAAC | 9498 |
| FBC_Oligo28 | CAGGTCGGCTTATGAGATCGTCGGACTGTAGAACTCTGAAC | 9499 |
| FBC_Oligo29 | CAGGTCCTAGTCCTCGATCGTCGGACTGTAGAACTCTGAAC | 9500 |
| FBC_Oligo30 | CAGGTCCTAGAGGAGGATCGTCGGACTGTAGAACTCTGAAC | 9501 |
| FBC_Oligo31 | CAGGTCAGCTTTACCGATCGTCGGACTGTAGAACTCTGAAC | 9502 |
| FBC_Oligo32 | CAGGTCGTCCATGAAGATCGTCGGACTGTAGAACTCTGAAC | 9503 |
| FBC_Oligo33 | CAGGTCCTCGAACCTGATCGTCGGACTGTAGAACTCTGAAC | 9504 |
| FBC_Oligo34 | CAGGTCCATTGTACGGATCGTCGGACTGTAGAACTCTGAAC | 9505 |
| FBC_Oligo35 | CAGGTCTTGAACGCTGATCGTCGGACTGTAGAACTCTGAAC | 9506 |
| FBC_Oligo36 | CAGGTCTACGTCATGGATCGTCGGACTGTAGAACTCTGAAC | 9507 |
| FBC_Oligo37 | CAGGTCAAGCCGTTAGATCGTCGGACTGTAGAACTCTGAAC | 9508 |
| FBC_Oligo38 | CAGGTCCGGACGTATGATCGTCGGACTGTAGAACTCTGAAC | 9509 |
| FBC_Oligo39 | CAGGTCTCGTTACCGGATCGTCGGACTGTAGAACTCTGAAC | 9510 |

TABLE 2-continued

| Oligonucleotide Name | Oligonucleotide Sequence | SEQ ID NO: |
|---|---|---|
| FBC_Oligo40 | CAGGTCATCCCCCATGATCGTCGGACTGTAGAACTCTGAAC | 9511 |
| FBC_Oligo41 | CAGGTCCAGACGATTGATCGTCGGACTGTAGAACTCTGAAC | 9512 |
| FBC_Oligo42 | CAGGTCATCGATCCCGATCGTCGGACTGTAGAACTCTGAAC | 9513 |
| FBC_Oligo43 | CAGGTCCCTGAGGATGATCGTCGGACTGTAGAACTCTGAAC | 9514 |
| FBC_Oligo44 | CAGGTCAGCTCTTTGGATCGTCGGACTGTAGAACTCTGAAC | 9515 |
| FBC_Oligo45 | CAGGTCGGAATACGGGATCGTCGGACTGTAGAACTCTGAAC | 9516 |
| FBC_Oligo46 | CAGGTCCTATCCTGGGATCGTCGGACTGTAGAACTCTGAAC | 9517 |
| FBC_Oligo47 | CAGGTCGGTTGTAGTGATCGTCGGACTGTAGAACTCTGAAC | 9518 |
| FBC_Oligo48 | CAGGTCGAACGTAGCGATCGTCGGACTGTAGAACTCTGAAC | 9519 |
| FBC_Oligo49 | CAGGTCGTCTATCGGATCGTCGGACTGTAGAACTCTGAAC | 9520 |
| FBC_Oligo50 | CAGGTCTACGAGTGGATCGTCGGACTGTAGAACTCTGAAC | 9521 |
| FBC_Oligo51 | CAGGTCTCATGTCGGATCGTCGGACTGTAGAACTCTGAAC | 9522 |
| FBC_Oligo52 | CAGGTCAAACACCCGATCGTCGGACTGTAGAACTCTGAAC | 9523 |
| FBC_Oligo53 | CAGGTCACTAGTCCGATCGTCGGACTGTAGAACTCTGAAC | 9524 |
| FBC_Oligo54 | CAGGTCCGAGGAATGATCGTCGGACTGTAGAACTCTGAAC | 9525 |
| FBC_Oligo55 | CAGGTCACAATGGCGATCGTCGGACTGTAGAACTCTGAAC | 9526 |
| FBC_Oligo56 | CAGGTCTAGGTCTCGATCGTCGGACTGTAGAACTCTGAAC | 9527 |
| FBC_Oligo57 | CAGGTCTCTGTGAGGATCGTCGGACTGTAGAACTCTGAAC | 9528 |
| FBC_Oligo58 | CAGGTCGGGATTGAGATCGTCGGACTGTAGAACTCTGAAC | 9529 |
| FBC_Oligo59 | CAGGTCAACTCTGGGATCGTCGGACTGTAGAACTCTGAAC | 9530 |
| FBC_Oligo60 | CAGGTCAAACGCGTGATCGTCGGACTGTAGAACTCTGAAC | 9531 |
| FBC_Oligo61 | CAGGTCTCCTACGAGATCGTCGGACTGTAGAACTCTGAAC | 9532 |
| FBC_Oligo62 | CAGGTCTAGCAGGTGATCGTCGGACTGTAGAACTCTGAAC | 9533 |
| FBC_Oligo63 | CAGGTCCCTGCATTGATCGTCGGACTGTAGAACTCTGAAC | 9534 |
| FBC_Oligo64 | CAGGTCGTGATGCAGATCGTCGGACTGTAGAACTCTGAAC | 9535 |
| FBC_Oligo65 | CAGGTCCGATTCAGGATCGTCGGACTGTAGAACTCTGAAC | 9536 |
| FBC_Oligo66 | CAGGTCAGGATGACGATCGTCGGACTGTAGAACTCTGAAC | 9537 |
| FBC_Oligo67 | CAGGTCAGGCCATAGATCGTCGGACTGTAGAACTCTGAAC | 9538 |
| FBC_Oligo68 | CAGGTCGCTTGCTTGATCGTCGGACTGTAGAACTCTGAAC | 9539 |
| FBC_Oligo69 | CAGGTCTCCCAAGTGATCGTCGGACTGTAGAACTCTGAAC | 9540 |
| FBC_Oligo70 | CAGGTCTCAAGGCAGATCGTCGGACTGTAGAACTCTGAAC | 9541 |
| FBC_Oligo71 | CAGGTCACGAGGTAGATCGTCGGACTGTAGAACTCTGAAC | 9542 |
| FBC_Oligo72 | CAGGTCGGAACGAAGATCGTCGGACTGTAGAACTCTGAAC | 9543 |
| FBC_Oligo73 | CAGGTCAATCCCAGGATCGTCGGACTGTAGAACTCTGAAC | 9544 |
| FBC_Oligo74 | CAGGTCCGATAAGGGATCGTCGGACTGTAGAACTCTGAAC | 9545 |
| FBC_Oligo75 | CAGGTCTATCGCGAGATCGTCGGACTGTAGAACTCTGAAC | 9546 |
| FBC_Oligo76 | CAGGTCCGCATAACGATCGTCGGACTGTAGAACTCTGAAC | 9547 |
| FBC_Oligo77 | CAGGTCGTGCAGTTGATCGTCGGACTGTAGAACTCTGAAC | 9548 |

TABLE 2-continued

| Oligonucleotide Name | Oligonucleotide Sequence | SEQ ID NO: |
|---|---|---|
| FBC_Oligo78 | CAGGTCAGAACGCTGATCGTCGGACTGTAGAACTCTGAAC | 9549 |
| FBC_Oligo79 | CAGGTCTAGAGGTCGATCGTCGGACTGTAGAACTCTGAAC | 9550 |
| FBC_Oligo80 | CAGGTCCTGTGATGGATCGTCGGACTGTAGAACTCTGAAC | 9551 |
| FBC_Oligo81 | CAGGTCTAGAGCCAGATCGTCGGACTGTAGAACTCTGAAC | 9552 |
| FBC_Oligo82 | CAGGTCCTTGATGCGATCGTCGGACTGTAGAACTCTGAAC | 9553 |
| FBC_Oligo83 | CAGGTCTTCGTGTCGATCGTCGGACTGTAGAACTCTGAAC | 9554 |
| FBC_Oligo84 | CAGGTCTATCTGCGGATCGTCGGACTGTAGAACTCTGAAC | 9555 |
| FBC_Oligo85 | CAGGTCTGGTAGGAGATCGTCGGACTGTAGAACTCTGAAC | 9556 |
| FBC_Oligo86 | CAGGTCCCTAGACAGATCGTCGGACTGTAGAACTCTGAAC | 9557 |
| FBC_Oligo87 | CAGGTCAGTCAACGGATCGTCGGACTGTAGAACTCTGAAC | 9558 |
| FBC_Oligo88 | CAGGTCAAGGGTGAGATCGTCGGACTGTAGAACTCTGAAC | 9559 |
| FBC_Oligo89 | CAGGTCCTTCACACGATCGTCGGACTGTAGAACTCTGAAC | 9560 |
| FBC_Oligo90 | CAGGTCAGGTTGCTGATCGTCGGACTGTAGAACTCTGAAC | 9561 |
| FBC_Oligo91 | CAGGTCACCCGAAAGATCGTCGGACTGTAGAACTCTGAAC | 9562 |
| FBC_Oligo92 | CAGGTCGAAAAGGGGATCGTCGGACTGTAGAACTCTGAAC | 9563 |
| FBC_Oligo93 | CAGGTCACTTCCCAGATCGTCGGACTGTAGAACTCTGAAC | 9564 |
| FBC_Oligo94 | CAGGTCTGCTGCATGATCGTCGGACTGTAGAACTCTGAAC | 9565 |
| FBC_Oligo95 | CAGGTCATTCCTGGGATCGTCGGACTGTAGAACTCTGAAC | 9566 |
| FBC_Oligo96 | CAGGTCCAGAACTCGATCGTCGGACTGTAGAACTCTGAAC | 9567 |

Table 2 describes a list of ooligonucleotide sequences used to generate the first set of barcoded beads (FBC) for combinatorial synthesis in Experiment 1.

The dual-biotinylated oligonucleotide was annealed at a final concentration of 2 µM in the presence of a four-fold molar excess of the barcoded oligonucleotide in a 96-well plate by stepwise cooling from 85° C. to 30° C. over 30 minutes. A DNA polymerase master mix was then added to each well such that the final concentration of the reaction components was 1×NEB Buffer 2 (New England BioLabs), 0.25 U/µL Klenow Fragment (exo-) (New England BioLabs), and 0.5 mM dNTPs. The reaction was incubated in each well at 37 C for 30 minutes before heat inactivating the polymerase at 75° C. for 20 minutes.

An equal volume of beads was then added to each reaction mixture so that the extended, dual-biotinylated oligonucleotide could conjugate to the streptavidin coated beads at a final density of ~1 billion oligonucleotide primers per bead. The conjugation reaction was incubated at room temperature overnight on a rotisserie and quenched with biotin at a final concentration of 2 mM and sodium hydroxide at a final concentration of 125 mM to melt the template strand off of the beads. The beads were then pooled and washed five times in 125 mM sodium hydroxide supplemented with 0.1 mM biotin and then washed an additional three times with Wash Buffer and 0.1 mM biotin. The beads were then re-suspended in Hybridization Buffer (20 mM Tris pH 8.0, 1 M NaCl, 0.1% Tween-20) supplemented with 0.1 mM biotin.

The pooled beads were split into ten reactions to which one of ten partially complementary oligonucleotides (Table 3) each containing a specific second barcode was added at a final concentration of 5 µM. The second barcode-containing oligonucleotides were allowed to hybridize to the beads at room temperature overnight on a rotisserie.

TABLE 3

| Oligonucleotide Name | Oligonucleotide Sequence | SEQ ID NO: |
|---|---|---|
| SBC_Oligo1 | AAAAAAAAAAAAAAAAAAAAAAAAAGGTGATACAG GTCAAAAAAAAAGATCGTCGGACTGTAGAACTC | 9568 |
| SBC_Oligo2 | AAAAAAAAAAAAAAAAAAAAAAAATGAATGCCAG GTCAAAAAAAAAGATCGTCGGACTGTAGAACTC | 9569 |
| SBC_Oligo3 | AAAAAAAAAAAAAAAAAAAAAAAATGCCAAACAG GTCAAAAAAAAAGATCGTCGGACTGTAGAACTC | 9570 |

TABLE 3-continued

| Oligonucleotide Name | Oligonucleotide Sequence | SEQ ID NO: |
|---|---|---|
| SBC_Oligo4 | AAAAAAAAAAAAAAAAAAAAAAAAACAGAAGCAGGTCAAAAAAAAAGATCGTCGGACTGTAGAACTC | 9571 |
| SBC_Oligo5 | AAAAAAAAAAAAAAAAAAAAAAAAACACTGGACAGGTCAAAAAAAAAGATCGTCGGACTGTAGAACTC | 9572 |
| SBC_Oligo6 | AAAAAAAAAAAAAAAAAAAAAAAAACGATGATCAGGTCAAAAAAAAAGATCGTCGGACTGTAGAACTC | 9573 |
| SBC_Oligo7 | AAAAAAAAAAAAAAAAAAAAAAAAAGTGTCCACAGGTCAAAAAAAAAGATCGTCGGACTGTAGAACTC | 9574 |
| SBC_Oligo8 | AAAAAAAAAAAAAAAAAAAAAAAAATCCTCTTCAGGTCAAAAAAAAAGATCGTCGGACTGTAGAACTC | 9575 |
| SBC_Oligo9 | AAAAAAAAAAAAAAAAAAAAAAAAAGTGCAGTCAGGTCAAAAAAAAAGATCGTCGGACTGTAGAACTC | 9576 |
| SBC_Oligo10 | AAAAAAAAAAAAAAAAAAAAAAAAAGGTAGACAGGTCAAAAAAAAAGATCGTCGGACTGTAGAACTC | 9577 |

Table 3 describes oligonucleotide sequences used to generate the second set of barcoded beads (SBC) for combinatorial synthesis in Experiment 1.

The beads were then washed five times in Wash Buffer supplemented with 0.1 mM biotin and then re-suspended in a reaction mixture with final concentrations of 0.5 mM dNTPs, 1×NEB Buffer 2 (New England BioLabs), and 0.1 mM biotin. We included biotin in the wash and storage buffers in order to saturate any remaining streptavidin sites on the beads so that, in the even that a barcoded capture primer dissociates form a beads, it cannot re-associate with a different bead. The reactions were cooled to 16° C. on a thermocycler and Klenow Fragment (exo-) (New England BioLabs) was added at a final concentration of 0.25 U/μL. The reaction was incubated for one hour at 16° C. with mixing every 10 minutes with a pipette followed by heat inactivation at 75° C. for 20 minutes.

The ten reaction mixtures were then quenched and the hybridized strand was denatured by addition of sodium hydroxide to a final concentration of 125 mM. The reaction mixtures were then washed five times in 125 mM sodium hydroxide with 0.1 mM biotin, pooled, and then further washed three times with Wash Buffer supplemented with 0.1 mM biotin.

Procedure for Single Cell RNA-Seq Experiment 1

Prior to the experiment, each lane of the device was flushed with 0.1% Tween-20 solution and incubated for several hours to hydrate the microwells, which were subsequently washed with 2 mL of phosphate-buffered saline (PBS). Cell suspensions were counted using Countess automated cell counter (Life Technologies). A suspension of cells in PBS mixed with Calcein AM (live stain) dye was flowed in to each lane and incubated for ~5 mins, so that the cells load in to the microwells under gravity. After thoroughly washing out the excess cells with PBS, a suspension of barcoded capture beads that had been pre-counted by microscopy was introduced in PBS and allowed to load under gravity for ~5 mins. In an aspect, ~3,000 cells to each lane of the device was introduced. It is also noted that only 25% of the lower surface of each channel contains a microwell array, and so by expanding this area, the number of cells captured without incurring increased reagent costs for on-chip library generation were significantly increased (for example, as long as the size of the barcode pool was pooled). Excess beads were washed out thoroughly with PBS and the flow cell was incubated on ice. 20 μL 0.08% TritonX-100 (Sigma) supplemented with SUPERaseIN in PBS was flowed under ice-cold conditions immediately followed by fluorinert oil (Sigma) to seal the device. After two cycles of freeze-thaw at −80° C. to enhance cell lysis, the device was incubated at room temperature for 60 mins for mRNA capture (FIG. 2A).

Two of the lanes contained pure U87 and MCF10a cells, respectively, and other lanes were loaded with a mixture of both the cell types. All lanes were imaged twice, first with blue laser ($\lambda_{ex}$=473 nm, Dragon Lasers) for imaging the cells and secondly with a red laser ($\lambda_{ex}$=637 nm, Obis, Coherent) for imaging the beads labeled with AlexaFluor 647 tagged streptavidin. We used the two-color images to determine number of bead-cell pairs in the array. After an hour of incubation for mRNA capture, all the lanes were unsealed by rapid washing of the oil with 20 mM Tris, containing 1% TritonX-100 and SUPERaseIN, followed by Wash Buffer supplemented with SUPERaseIN. After this point the microwells stay open and subsequent enzymatic steps occur simultaneously in separate lanes of the open device.

The single cell library preparation protocol is adopted from the recently reported CEL-Seq protocol with few modifications as described below. The mRNA captured on the beads was reverse transcribed using ProtoScript II Reverse Transcriptase (New England Biolabs) for 2 hours at 42° C. in 1× ProtoScript Reverse Transcriptase buffer, supplemented with 10 mM DTT, 0.5 mM dNTPs, 0.1% Tween-20 and SUPERaseIN. The reaction mixture was washed out with Wash Buffer. The second strand synthesis was carried out using reagents from the MessageAmp II aRNA amplification kit (Ambion), where a mixture of DNA polymerase and RNaseH in second strand buffer was used along with dNTPs by incubating the device at 16° C. for 2 hours. After flushing out the second strand reaction mixture with Wash Buffer, an in vitro transcription mixture from the MessageAmp II kit containing four nucleotides and T7 RNA polymerase enzyme mix in T7 buffer was introduced to all lanes and incubated for 13 hours at 37° C. (FIGS. 5A-5C). The reaction linearly amplified our cDNA, eluting pools of barcoded aRNA into the flow channels of the device which was then removed from each lane using a pipette and purified separately using RNA Clean & Concentrator columns (Zymo) and eluted into five separate tubes. The aRNA from the 5 lanes was reverse transcribed separately using random hexamers tagged with five different barcodes and 8-base UMIs to differentiate cDNA for all five lanes and part of an Illumina sequencing adapter. The aRNA along with the hexamer primers was heated to 70° C. for 2 mins and immediately placed on ice for 5 mins. The reverse transcription mix containing PrimeScript Reverse Transcriptase (Clontech-Takara), 0.5 mM dNTPs, 10 mM DTT, 1× PrimeScript buffer supplemented with SUPERaseIN was added and incubated at 25° C. for 10 mins followed by 2 hour incubation at 42° C. The RNA-cDNA hybrid product was purified twice using 0.65× ratio of Agencourt Ampure beads (Beckman Coulter) and the purified cDNA from all the lanes were pooled together for PCR. Phusion High Fidelity DNA polymerase (New England Biolabs) was used for amplifying the cDNA using RP1 and RPI Illumina primers in 1× PhusionHF buffer supplemented with dNTPs. The PCR product was purified on a 1.5% agarose gel which was stained with SybrGold (Life Technologies) before being cut between 400-800 bp. The library was extracted from the gel using Gel Extraction kit (Qiagen), and further purified and concentrated using a 0.65× ratio of the AMpure beads (Beckman Coulter). The final library was quantified using a Qubit (Life Technologies) and Bioanalyzer (Agilent) and sequenced on NextSeq 500 desktop sequencer (Illumina). ~240 million paired-end reads with a 26-base first read and a 66-base second read were obtained.

Procedure for Single Cell RNA-Seq Experiment 2

Experiment 2 was identical to Experiment 1 with a few exceptions. First, the two cell types under study were U87 human glioma cells and WI-38 human fibroblast cells (a diploid, limited-passage, non-cancer cell line). Second, reagents from the HiScribe In Vitro Transcription kit (New England BioLabs) were substituted for the MessageAmp II kit for the IVT portion of the protocol. Third, some of the oligonucleotides used were different from in Experiment 1 and are tabulated as detailed in Tables 4-6.

Table 4 describes a group of preferred oligonucleotides used for barcoding and library preparation for Experiment 2.

TABLE 4

| Oligonucleotide Name | Oligonucleotide Sequence | SEQ ID NO: |
| --- | --- | --- |
| Bead Capture Oligo (5'-dual biotinylated) | AGGTAAGGTAATACGACTCACTATAGGGGTTCAGAGTTCTACAGTCCGACGATC | 9578 |
| RT1 (Reverse Transcription Primer for Lane 1) | GCCTTGGCACCCGAGAATTCCANNNNNNNNCGTCATNNNNNN | 9579 |
| RT2 (Reverse Transcription Primer for Lane 2) | GCCTTGGCACCCGAGAATTCCANNNNNNNNTACCCANNNNNN | 9580 |
| RT3 (Reverse Transcription Primer for Lane 3) | GCCTTGGCACCCGAGAATTCCANNNNNNNNGCCATTNNNNNN | 9581 |
| RT4 (Reverse Transcription Primer for Lane 4) | GCCTTGGCACCCGAGAATTCCANNNNNNNNGAGTACNNNNNN | 9582 |
| RT5 (Reverse Transcription Primer for Lane 5) | GCCTTGGCACCCGAGAATTCCANNNNNNNNAGAGTCNNNNNN | 9583 |
| RP1 (PCR Primer 1) | AATGATACGGCGACCACCGAGATCTACACGTTCAGAGTTCTACAGTCCGA | 9584 |
| RPI2 (PCR Primer 2) | CAAGCAGAAGACGGCATACGAGATACATCGGTGACTGGAGTTCCTTGGCACCCGAGAATTCCA | 9585 |

Table 5 describes oligonucleotide sequences used to generate the first set of barcoded beads (FBC) for combinatorial synthesis in Experiment 2.

TABLE 5

| Oligonucleotide Name | Oligonucleotide Sequence | SEQ ID NO: |
| --- | --- | --- |
| FBC_Oligo1 | CAGGTCCTGATCGATGATCGTCGGACTGTAGAACTCTGAAC | 9586 |
| FBC_Oligo2 | CAGGTCGTGTAGACAGATCGTCGGACTGTAGAACTCTGAAC | 9587 |
| FBC_Oligo3 | CAGGTCCATTGTTCCGATCGTCGGACTGTAGAACTCTGAAC | 9588 |

TABLE 5-continued

| Oligonucleotide Name | Oligonucleotide Sequence | SEQ ID NO: |
|---|---|---|
| FBC_Oligo4 | CAGGTCCTTGACTACGATCGTCGGACTGTAGAACTCTGAAC | 9589 |
| FBC_Oligo5 | CAGGTCACCGTTTCGGATCGTCGGACTGTAGAACTCTGAAC | 9590 |
| FBC_Oligo6 | CAGGTCAAGGACCGTGATCGTCGGACTGTAGAACTCTGAAC | 9591 |
| FBC_Oligo7 | CAGGTCTCACTATGCGATCGTCGGACTGTAGAACTCTGAAC | 9592 |
| FBC_Oligo8 | CAGGTCCTGCAATGGGATCGTCGGACTGTAGAACTCTGAAC | 9593 |
| FBC_Oligo9 | CAGGTCTGAGTCGTCGATCGTCGGACTGTAGAACTCTGAAC | 9594 |
| FBC_Oligo10 | CAGGTCCTCACACTAGATCGTCGGACTGTAGAACTCTGAAC | 9595 |
| FBC_Oligo11 | CAGGTCTTACCCCCTGATCGTCGGACTGTAGAACTCTGAAC | 9596 |
| FBC_Oligo12 | CAGGTCCCAAGTAGAGATCGTCGGACTGTAGAACTCTGAAC | 9597 |
| FBC_Oligo13 | CAGGTCATAGCGCACGATCGTCGGACTGTAGAACTCTGAAC | 9598 |
| FBC_Oligo14 | CAGGTCTGACGTACGGATCGTCGGACTGTAGAACTCTGAAC | 9599 |
| FBC_Oligo15 | CAGGTCGTAGAGTTGGATCGTCGGACTGTAGAACTCTGAAC | 9600 |
| FBC_Oligo16 | CAGGTCTTTCTGGCGGATCGTCGGACTGTAGAACTCTGAAC | 9601 |
| FBC_Oligo17 | CAGGTCGGAATGTGTGATCGTCGGACTGTAGAACTCTGAAC | 9602 |
| FBC_Oligo18 | CAGGTCCTATGGAAGGATCGTCGGACTGTAGAACTCTGAAC | 9603 |
| FBC_Oligo19 | CAGGTCAAGTCCATGGATCGTCGGACTGTAGAACTCTGAAC | 9604 |
| FBC_Oligo20 | CAGGTCAGTACTTGGGATCGTCGGACTGTAGAACTCTGAAC | 9605 |
| FBC_Oligo21 | CAGGTCACAGGACTAGATCGTCGGACTGTAGAACTCTGAAC | 9606 |
| FBC_Oligo22 | CAGGTCACCAGGTAAGATCGTCGGACTGTAGAACTCTGAAC | 9607 |
| FBC_Oligo23 | CAGGTCGCATGAACCGATCGTCGGACTGTAGAACTCTGAAC | 9608 |
| FBC_Oligo24 | CAGGTCGTTGGTGTTGATCGTCGGACTGTAGAACTCTGAAC | 9609 |
| FBC_Oligo25 | CAGGTCCCTTCAGACGATCGTCGGACTGTAGAACTCTGAAC | 9610 |
| FBC_Oligo26 | CAGGTCCCTCTTGGTGATCGTCGGACTGTAGAACTCTGAAC | 9611 |
| FBC_Oligo27 | CAGGTCGGGAAAGTTGATCGTCGGACTGTAGAACTCTGAAC | 9612 |
| FBC_Oligo28 | CAGGTCAGCCAGAGTGATCGTCGGACTGTAGAACTCTGAAC | 9613 |
| FBC_Oligo29 | CAGGTCTCGCATCTGGATCGTCGGACTGTAGAACTCTGAAC | 9614 |
| FBC_Oligo30 | CAGGTCGATACGGCAGATCGTCGGACTGTAGAACTCTGAAC | 9615 |
| FBC_Oligo31 | CAGGTCTCGGCCAAAGATCGTCGGACTGTAGAACTCTGAAC | 9616 |
| FBC_Oligo32 | CAGGTCAGATTTCGCGATCGTCGGACTGTAGAACTCTGAAC | 9617 |
| FBC_Oligo33 | CAGGTCGACCCTCAAGATCGTCGGACTGTAGAACTCTGAAC | 9618 |
| FBC_Oligo34 | CAGGTCAGTCCACTCGATCGTCGGACTGTAGAACTCTGAAC | 9619 |
| FBC_Oligo35 | CAGGTCCAAACGATCGATCGTCGGACTGTAGAACTCTGAAC | 9620 |
| FBC_Oligo36 | CAGGTCGCCTAATAGGATCGTCGGACTGTAGAACTCTGAAC | 9621 |
| FBC_Oligo37 | CAGGTCGGCTACATCGATCGTCGGACTGTAGAACTCTGAAC | 9622 |
| FBC_Oligo38 | CAGGTCTATGAGCAGGATCGTCGGACTGTAGAACTCTGAAC | 9623 |
| FBC_Oligo39 | CAGGTCGGTAGTAACGATCGTCGGACTGTAGAACTCTGAAC | 9624 |
| FBC_Oligo40 | CAGGTCCGCGTATATGATCGTCGGACTGTAGAACTCTGAAC | 9625 |
| FBC_Oligo41 | CAGGTCTACTGGAGCGATCGTCGGACTGTAGAACTCTGAAC | 9626 |

TABLE 5-continued

| Oligonucleotide Name | Oligonucleotide Sequence | SEQ ID NO: |
|---|---|---|
| FBC_Oligo42 | CAGGTCAGGGAATCAGATCGTCGGACTGTAGAACTCTGAAC | 9627 |
| FBC_Oligo43 | CAGGTCATCCGAGATGATCGTCGGACTGTAGAACTCTGAAC | 9628 |
| FBC_Oligo44 | CAGGTCTCCCAAGCAGATCGTCGGACTGTAGAACTCTGAAC | 9629 |
| FBC_Oligo45 | CAGGTCGAGCCGTTTGATCGTCGGACTGTAGAACTCTGAAC | 9630 |
| FBC_Oligo46 | CAGGTCTGCTCTTACGATCGTCGGACTGTAGAACTCTGAAC | 9631 |
| FBC_Oligo47 | CAGGTCACGACTACCGATCGTCGGACTGTAGAACTCTGAAC | 9632 |
| FBC_Oligo48 | CAGGTCCAAGCAGCTGATCGTCGGACTGTAGAACTCTGAAC | 9633 |
| FBC_Oligo49 | CAGGTCGTATTCGCGATCGTCGGACTGTAGAACTCTGAAC | 9634 |
| FBC_Oligo50 | CAGGTCGCTCTGAAGATCGTCGGACTGTAGAACTCTGAAC | 9635 |
| FBC_Oligo51 | CAGGTCACGTAGTGGATCGTCGGACTGTAGAACTCTGAAC | 9636 |
| FBC_Oligo52 | CAGGTCATTGGGTCGATCGTCGGACTGTAGAACTCTGAAC | 9637 |
| FBC_Oligo53 | CAGGTCAACAGCACGATCGTCGGACTGTAGAACTCTGAAC | 9638 |
| FBC_Oligo54 | CAGGTCTCAGAGACGATCGTCGGACTGTAGAACTCTGAAC | 9639 |
| FBC_Oligo55 | CAGGTCGTGTGCTAGATCGTCGGACTGTAGAACTCTGAAC | 9640 |
| FBC_Oligo56 | CAGGTCGCAGTTGAGATCGTCGGACTGTAGAACTCTGAAC | 9641 |
| FBC_Oligo57 | CAGGTCTTAACGGGGATCGTCGGACTGTAGAACTCTGAAC | 9642 |
| FBC_Oligo58 | CAGGTCGCTCGATTGATCGTCGGACTGTAGAACTCTGAAC | 9643 |
| FBC_Oligo59 | CAGGTCACACCTGTGATCGTCGGACTGTAGAACTCTGAAC | 9644 |
| FBC_Oligo60 | CAGGTCAGACGGTTGATCGTCGGACTGTAGAACTCTGAAC | 9645 |
| FBC_Oligo61 | CAGGTCGCAAACCAGATCGTCGGACTGTAGAACTCTGAAC | 9646 |
| FBC_Oligo62 | CAGGTCGAGTATGGATCGTCGGACTGTAGAACTCTGAAC | 9647 |
| FBC_Oligo63 | CAGGTCGGTCTTTCGATCGTCGGACTGTAGAACTCTGAAC | 9648 |
| FBC_Oligo64 | CAGGTCCATCTGCTGATCGTCGGACTGTAGAACTCTGAAC | 9649 |
| FBC_Oligo65 | CAGGTCTTCGCAAGGATCGTCGGACTGTAGAACTCTGAAC | 9650 |
| FBC_Oligo66 | CAGGTCTTGTGACGGATCGTCGGACTGTAGAACTCTGAAC | 9651 |
| FBC_Oligo67 | CAGGTCTGCATGACGATCGTCGGACTGTAGAACTCTGAAC | 9652 |
| FBC_Oligo68 | CAGGTCCAACGTGAGATCGTCGGACTGTAGAACTCTGAAC | 9653 |
| FBC_Oligo69 | CAGGTCTAGGCTTCGATCGTCGGACTGTAGAACTCTGAAC | 9654 |
| FBC_Oligo70 | CAGGTCTGGTAGGAGATCGTCGGACTGTAGAACTCTGAAC | 9655 |
| FBC_Oligo71 | CAGGTCTGCAGCTTGATCGTCGGACTGTAGAACTCTGAAC | 9656 |
| FBC_Oligo72 | CAGGTCCTGTACCTGATCGTCGGACTGTAGAACTCTGAAC | 9657 |
| FBC_Oligo73 | CAGGTCCGCAATGAGATCGTCGGACTGTAGAACTCTGAAC | 9658 |
| FBC_Oligo74 | CAGGTCGATCCAAGGATCGTCGGACTGTAGAACTCTGAAC | 9659 |
| FBC_Oligo75 | CAGGTCCACTTACGGATCGTCGGACTGTAGAACTCTGAAC | 9660 |
| FBC_Oligo76 | CAGGTCAACTAGGCGATCGTCGGACTGTAGAACTCTGAAC | 9661 |
| FBC_Oligo77 | CAGGTCACTAGCGTGATCGTCGGACTGTAGAACTCTGAAC | 9662 |
| FBC_Oligo78 | CAGGTCCGTTCGTTGATCGTCGGACTGTAGAACTCTGAAC | 9663 |
| FBC_Oligo79 | CAGGTCAGTCACGAGATCGTCGGACTGTAGAACTCTGAAC | 9664 |
| FBC_Oligo80 | CAGGTCCCTGTAACGATCGTCGGACTGTAGAACTCTGAAC | 9665 |

TABLE 5-continued

| Oligonucleotide Name | Oligonucleotide Sequence | SEQ ID NO: |
|---|---|---|
| FBC_Oligo81 | CAGGTCGTCCTCTTGATCGTCGGACTGTAGAACTCTGAAC | 9666 |
| FBC_Oligo82 | CAGGTCCAGCGAATGATCGTCGGACTGTAGAACTCTGAAC | 9667 |
| FBC_Oligo83 | CAGGTCATGGTTGGGATCGTCGGACTGTAGAACTCTGAAC | 9668 |
| FBC_Oligo84 | CAGGTCGAGGTTCTGATCGTCGGACTGTAGAACTCTGAAC | 9669 |
| FBC_Oligo85 | CAGGTCTACCTCGAGATCGTCGGACTGTAGAACTCTGAAC | 9670 |
| FBC_Oligo86 | CAGGTCTTCTGTGCGATCGTCGGACTGTAGAACTCTGAAC | 9671 |
| FBC_Oligo87 | CAGGTCGACAACTGGATCGTCGGACTGTAGAACTCTGAAC | 9672 |
| FBC_Oligo88 | CAGGTCCGACAACAGATCGTCGGACTGTAGAACTCTGAAC | 9673 |
| FBC_Oligo89 | CAGGTCTCGATACCGATCGTCGGACTGTAGAACTCTGAAC | 9674 |
| FBC_Oligo90 | CAGGTCCCATACTCGATCGTCGGACTGTAGAACTCTGAAC | 9675 |
| FBC_Oligo91 | CAGGTCATTCGCAGGATCGTCGGACTGTAGAACTCTGAAC | 9676 |
| FBC_Oligo92 | CAGGTCACCATAGGGATCGTCGGACTGTAGAACTCTGAAC | 9677 |
| FBC_Oligo93 | CAGGTCCGATCAAGGATCGTCGGACTGTAGAACTCTGAAC | 9678 |
| FBC_Oligo94 | CAGGTCACCTTGCTGATCGTCGGACTGTAGAACTCTGAAC | 9679 |
| FBC_Oligo95 | CAGGTCGACTCAGTGATCGTCGGACTGTAGAACTCTGAAC | 9680 |
| FBC_Oligo96 | CAGGTCGTCAATCCGATCGTCGGACTGTAGAACTCTGAAC | 9681 |

Table 6 provides for oligonucleotide sequences used to generate the second set of barcoded beads (SBC) for combinatorial synthesis in Experiment 2.

TABLE 6

| Oligonucleotide Name | Oligonucleotide Sequence | SEQ ID NO: |
|---|---|---|
| SBC_Oligo1 | AAAAAAAAAAAAAAAAAAAAAAAAGGTGATACAGGTCAAAAAAAAAGATCGTCGGACTGTAGAACTC | 9682 |
| SBC_Oligo2 | AAAAAAAAAAAAAAAAAAAAAAAATGAATGCCAGGTCAAAAAAAAAGATCGTCGGACTGTAGAACTC | 9683 |
| SBC_Oligo3 | AAAAAAAAAAAAAAAAAAAAAAAATGCCAAACAGGTCAAAAAAAAAGATCGTCGGACTGTAGAACTC | 9684 |
| SBC_Oligo4 | AAAAAAAAAAAAAAAAAAAAAAAACAGAAGCAGGTCAAAAAAAAAGATCGTCGGACTGTAGAACTC | 9685 |
| SBC_Oligo5 | AAAAAAAAAAAAAAAAAAAAAAAACACTGGACAGGTCAAAAAAAAAGATCGTCGGACTGTAGAACTC | 9686 |
| SBC_Oligo6 | AAAAAAAAAAAAAAAAAAAAAAAACGATGATCAGGTCAAAAAAAAAGATCGTCGGACTGTAGAACTC | 9687 |
| SBC_Oligo7 | AAAAAAAAAAAAAAAAAAAAAAAAGTGTCCACAGGTCAAAAAAAAAGATCGTCGGACTGTAGAACTC | 9688 |
| SBC_Oligo8 | AAAAAAAAAAAAAAAAAAAAAAAATCCTCTTCAGGTCAAAAAAAAAGATCGTCGGACTGTAGAACTC | 9689 |
| SBC_Oligo9 | AAAAAAAAAAAAAAAAAAAAAAAAGTGCAGTCAGGTCAAAAAAAAAGATCGTCGGACTGTAGAACTC | 9690 |
| SBC_Oligo10 | AAAAAAAAAAAAAAAAAAAAAAAAGGTAGACAGGTCAAAAAAAAAGATCGTCGGACTGTAGAACTC | 9691 |

Analysis of Single Cell RNA-Seq Data

Read 1 of the single cell RNA-Seq data contains a cell-identifying barcode sequence followed by poly(dT), and read 2 contains a 8-base UMI followed by a 6-base lane-identifying barcode and a transcript sequence. The reads are first demultiplex based on the lane-identifying barcode while recording the corresponding UMI using a custom Python script. We then map the remainder of read 2 to the human genome and transcriptome (hg19, Ensembl annotation from Illumina iGenomes) using the STAR aligner. Mapped reads for each lane are then demultiplexed based on the cell-identifying barcodes in read 1 and assigned to a gene using HTSeq. Both the lane- and cell-identifying barcodes were allowed to have a single-base mismatch during demultiplexing.

The set of reads that uniquely mapped to the transcriptome were collected and assigned an address comprised of its cell-identifying barcode, gene, UMI, and mapping position. In addition, the reads that mapped to both the genome and transcriptome were kept, but that mapped to only one position on the transcriptome and mapped to that position with the appropriate strand-specificity. The reads to identify unique molecules were filtered. Reads with identical addresses were collapsed to a single molecule. In addition, reads with identical cell-identifying barcodes, genes, mapping positions, and with UMIs having a Hamming distance less than or equal to two were collapsed to a single molecule. All reads considered identical molecules by the above definition (UMIs with a Hamming distance less than or equal to two and mapping position within six bases) were removed but that also occurred with different cell-identifying barcodes within the same lane. This approach likely underestimates of the true number of molecules associated with each cell and gene and results in some loss of gene detection. However, it also removes molecules that may become spuriously associated with the incorrect cell via PCR recombination, as observed and similarly filtered in previous studies that used very similar library construction protocols.

To identify barcodes that correspond to actual individual cells in our device in Experiment 1, the observed cell-identifying barcodes were filtered by progressively down-sampling the corresponding gene profiles to the same number of total reads and assessing the number of unique molecules detected from each cell-identifying barcode. After excluding cell-identifying barcodes having zero associated molecules, it was found that the distribution of associated unique molecules to be bimodal, with one small subpopulation having nearly as many unique molecules as reads at low read totals. It was found the size of this subpopulation to be in excellent agreement with our device imaging data. These 598 profiles were taken to represent the actual individual cells captured in the device with a barcoded bead. We used the same approach to assess the cell-identifying barcodes in Experiment 2.

The 396 single-cell profiles were kept with the highest coverage in the data set (all five lanes represented). The U87 and MCF10a single cell profiles were compared to bulk RNA-Seq profiles of U87 and MCF10a cells. Bulk RNA-Seq library from ~$10^7$ U87 cells were prepared using the TruSeq RNA-Seq library preparation kit (Illumina) and sequenced the library to a depth of ~30M, 100-base single-end reads on an Illumina HiSeq 2500. Publically available bulk RNA-Seq profile of MCF10a cells was obtained from the Gene Expression Omnibus (entry GSE45258). Reads were mapped to the transcriptome as described above and expression values (FPKM) were computed using Cufflinks. Pearson correlation coefficients between single cell and bulk profiles were computed between log-transformed single-cell expression profiles (unique molecules per million reads plus one) and log-transformed bulk values (FPKM plus one). Single cell median profiles were generated from different numbers of randomly selected single cell profiles and repeated this random sampling ten times without replacement for each data point in FIGS. 7A and 7B. For each Pearson correlation calculation, only genes with log-transformed single cell median or bulk values greater than 0.5 were included.

Differential expression analysis was conducted by comparing each detected gene in the two cell type-exclusive lanes using Wilcoxin's rank-sum test. Genes with $p<0.05$ were used for clustering analysis. Regardless of differential expression $+/-(1-p)$ was used (which is positive for expression biased in one cell type and negative for expression biased towards a second cell type) for each gene as input to iPAGE, a mutual information-based algorithm that can associate gene ontologies with genes based on an assigned numerical value [35]. A matrix of pairwise Spearman correlation coefficients was generated based on unique molecules detected across 396 single cell profiles in Experiment 1 (247 profiles in Experiment 2) using only the differentially expressed genes. The data was then clustered with the MATLAB implementation t-SNE using the correlation matrix as input. The single cell profiles were color coated in the t-SNE clusters using a simple classifier score given by the log-ratio of the number of cell type-specific genes for each of the two cell types in a given cell with an above-average rank in expression level (FIG. 8C).

Table 7 describes estimated costs per reagents and associated costs in an aspect of the disclosure.

TABLE 7

| Reagent | Volume | Stock Volume | Price of Stock | Price per Run |
|---|---|---|---|---|
| SUPERaseIN (Ambion) | 19 uL | 500 uL | $350.40 | $13.32 |
| dNTPs (NEB) | 10 uL | 800 uL | $44.80 | $0.56 |
| HiScribe IVT Kit (NEB) | 1 uL | 50 uL | $169.60 | $3.39 |
| MessageAamp II Kit (Ambion) | 3 uL | 740 uL | $3,668.00 | $14.87 |
| PrimeScript RT (Clontech) | 5 uL | 200 uL | $501.63 | $12.54 |
| Phusion polymerase (NEB) | 0.5 uL | 250 uL | $336.00 | $0.67 |
| Lane Barcode RT primers (IDT) | 15 uL | 3155 uL | $542.25 | $0.86 |
| NHS beads (GE) | 3.25 uL | 25000 uL | $155.80 | $0.02 |
| Streptavidin (NEB) | 5 uL | 1000 uL | $188.80 | $0.94 |
| Dual-biotin anchor oligo (IDT) | 0.64 uL | 700 uL | $225.75 | $0.21 |
| Klenow fragment exo-(NEB) | 1.5 uL | 200 uL | $188.80 | $1.42 |
| dNTPs (NEB) | 3.5 uL | 800 uL | $44.80 | $0.20 |
| FBC primers (IDT) | 0.96 uL (all 96) | 240,000 (all 96) | $484.56 total | $0.002 |
| SBC primers (IDT) | 0.66 uL (all 10) | 4000 uL (all 10) | $340.00 total | $0.67 |
| Experiment Costs | | | | $46.21 |
| Bead Costs | | | | $3.46 |
| Total Cost per Run | | | | $49.67 |
| Cost per Cell | | 250-500 cells | | $0.10-$0.20 |

Example 3

Bead Synthesis 1 million sequence-barcoded mRNA capture beads (MA-COSKO-2011-10, ChemGenes) were washed 6 times with DI water, re-suspended in 1280 uL of DI water, and evenly distributed to 64 wells on a 96-well plate. The plate is then sealed with adhesive cover, vortexed for 5 minutes, centrifuged at 300 g for 1 minute, sonicated in a water batch sonicator (FS-20, Fisher Scientific) for 5 minutes, incubated at 4° C. for 12 hours, and centrifuged again at 300 g for 1 minute.

Figure 19:
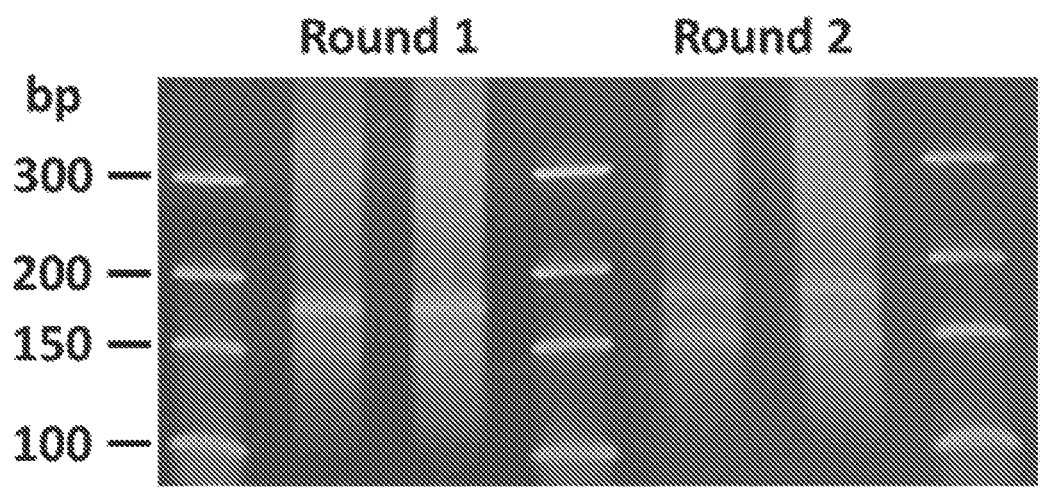
FIG. 19 shows gel electrophoresis analysis of the bead-free oligo PCR product from a first (left) and second (right) round of bead synthesis reactions.
Figure 20:
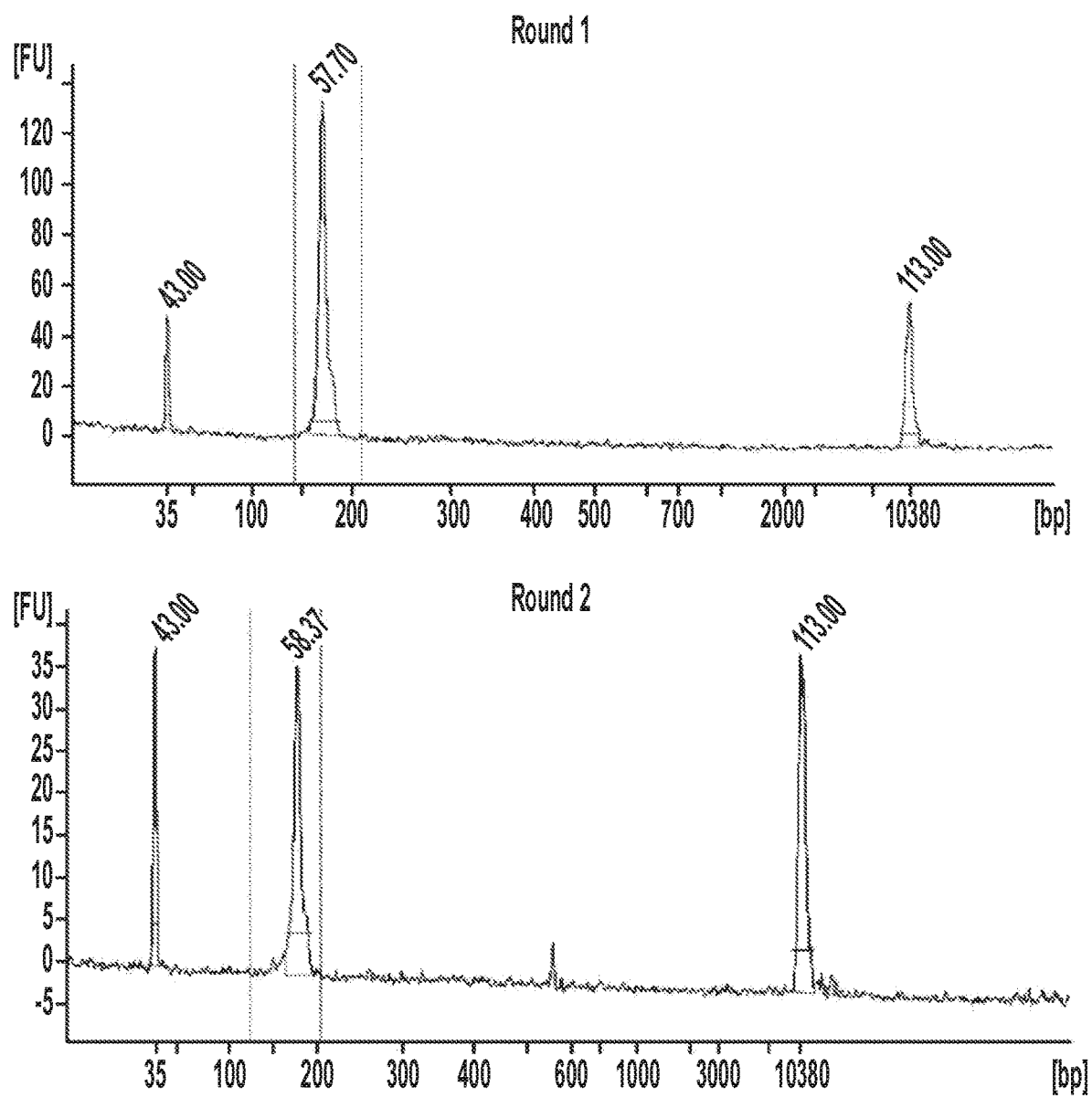
FIGS. 20A and 20B show capillary electrophoresis analysis of the gel-purified bead-free oligo PCR product from a first round (FIG. 20A) and a second round (FIG. 20B) of bead synthesis reactions.

Library Preparation and Sequencing of the Bead-Free DNA 5 uL supernatant from each well was collected and mixed with 10 uL of 1 uM NexterapolyA primer and 2 uL 10×NEBuffer 2 (B7002S, NEB) in separate wells on a 96-well plate. The mixtures were incubated at 95° C. for 2 minutes, then cooled down to 25° C. on a thermocycler. 2 uL of 10 mM dNTPs (N04475, NEB) and 1 uL of DNA polymerase (M0212S, NEB) were then added to each reaction mixture, incubated at 25° C. for 15 minutes and at 37° C. for 1 hour followed by heat inactivation of the DNA polymerase at 75° C. for 20 minutes, then cooled down to 4° C. 4 uL sample from each reaction was mixed with 2 uL of 2 uM well-specific barcoded custom P7 primer, 2 uL of 2 uM custom P5 primer (AATGATACGGCGAC-CACCGAGATCTACACGCCTGTCCGCG-GAAGCAGTGGTATC AACGCAGAGT*A*C, (SEQ ID NO: 9692) IDT), and 8 uL of 2× Kapa HiFi Hotstart Readymix (KK2601, Kapabiosystems). The mixture was then subjected to a PCR amplification protocol (95 C 3 minutes, 14 cycles of (95 C 10 s, 55 C 30 s, 72 C 30 s), 72 C 5 minutes, hold at 4 C). 5 uL of the PCR product from each reaction were pooled together and purified using the solid-phase reversible immobilization (SPRI) paramagnetic bead technology (A63880, Beckman Coulter) with a 2:1 bead-to-sample volume ratio and eluted in 50 uL of nuclease free water. The PCR product was further purified by gel electrophoresis (456-5034, Biorad). A 180 bp gel band (FIG. 19) was observed and extracted. The extracted product was further analyzed by capillary gel electrophoresis (5067-4626, Agilent Technologies) to further examine the length distribution of the purified product (FIGS. 20A and 20B).

Ligation of Optical Oligoes to the mRNA Capture Beads

The remaining beads in each well were washed with DI water and resuspended in a 50 uL reaction mixture that contained 5 uL of 10× T4 RNA ligase reaction buffer (M0204S, NEB), 25 uL of 50% PEG 8000 (M0204S, NEB), 5 uL of 10 Mm ATP (M0204S, NEB), 1 uL of 5% Tween-20, 2.5 uL of T4 RNA ligase 1 (M0204S, NEB), a well-specific unique combination of a set of 6 optical barcode oligo species (2 uL at 100 uM each), and water. The reactions were incubated at room temperature for 24 hours on a rotisserie. 5 uL of 10% SDS and 1 uL of 500 Mm EDTA were then added to each well, and incubated for 5 minutes at room temperature. All beads were then pooled together into a single microcentrifuge tube, washed twice with TE/TW buffer (10 mM Tris-HCl, 1 mM EDTA, 0.01% Tween-20, pH 8.0) and re-suspended in 1280 uL of TE/TW buffer.

The beads were subjected to a second round of the synthesis workflow described above using a separate set of 64 well-specific barcoded custom P7 primers in the PCR amplification of bead-free oligoes and a separate set of 6 optical barcode oligoes for the ligation reactions.

The 128 bead-free DNA libraries resulted from the above two rounds of synthesis reactions were sequenced on a NextSeq 500 machine (Illumina) with a custom read 1 sequencing primer (GCCTGTCCGCG-GAAGCAGTGGTATCAACGCAGAGTAC (SEQ ID NO: 9693), IDT). 21 bases were sequenced on read 1. The resulting raw fastq files were processed to obtain the list of sequence-barcoded mRNA capture beads that were present in each of the 128 ligation reactions to which a unique known combination of optical barcode oligoes were added. Thus, a two-column look-up table was obtained where each row represents a bead, one column contains a 12-base sequencing barcode sequence, and the other column contains a 12-digit binary optical barcode sequence.

Example 4: Mixed Species Experiment

Figure 21:
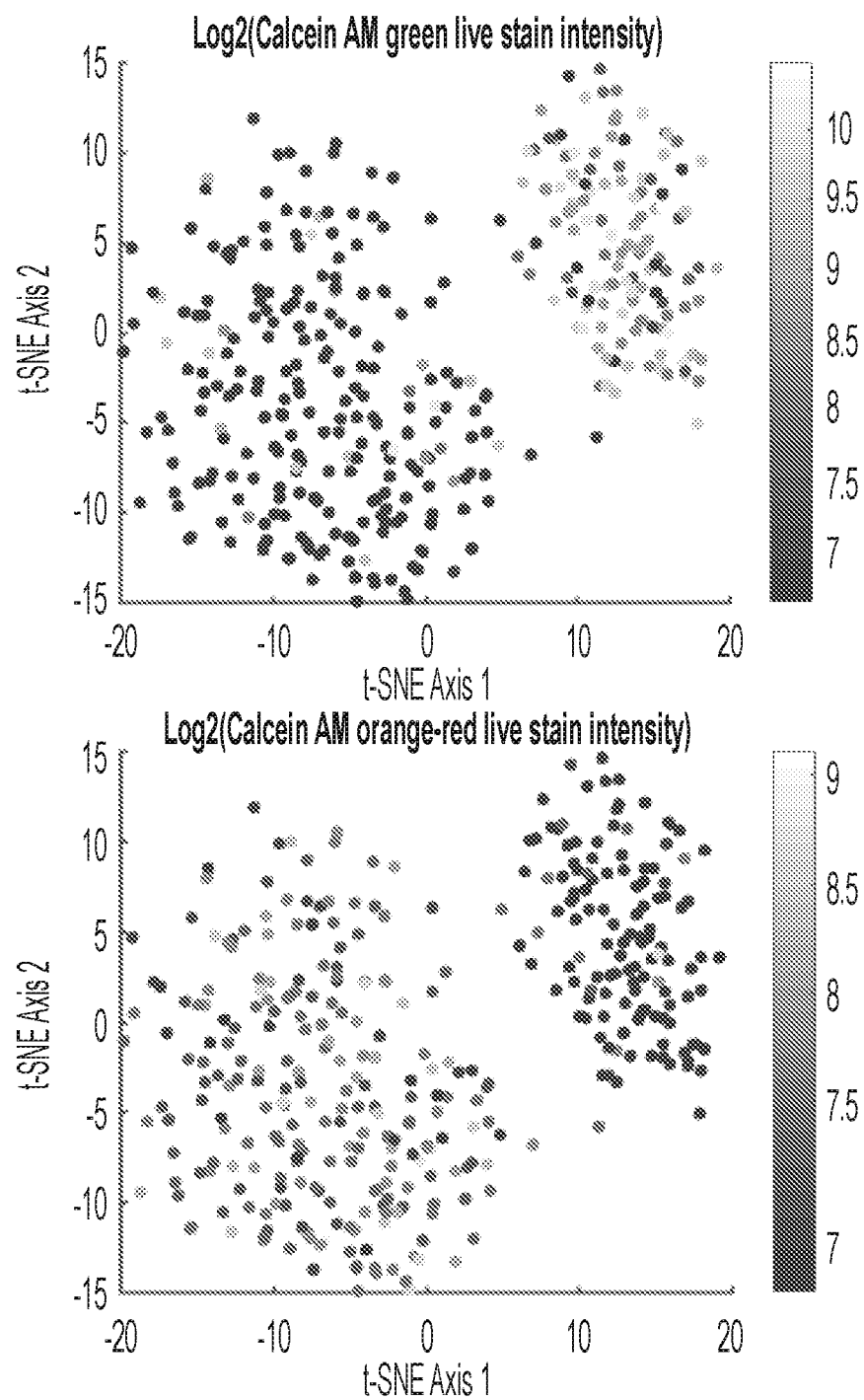
FIGS. 21A and 21B present integrated sequencing and imaging data for a mixed species experiment.

FIGS. 21A and 21B present integrated sequencing and imaging data for a mixed species experiment. Mixed human-mouse single-cell RNA-Seq data was projected using tSNE, revealing two clusters of cells that correspond to U87 (human) and 3T3 (mouse). The points in the tSNE plot were shaded according to the fluorescence intensity of the two live stain dyes, one of which was used to stain U87 (human) and 3T3 (mouse). The vast majority of cells with high fluorescence intensity in the channel used to image human cells are in the human cluster and vice versa, demonstrating the efficacy of the approach even without any error-correcting barcodes.

Device Preparation

On the day before the experiment, a microwell array flow cell device that has 15,000 microwells was filled with wash buffer (20 Mm Tris-HCl, 50 Mm NaCl, 0.1% Tween-20, pH 7.9) and stored in a humid chamber (a pipette tip box half-filled with water) at room temperature. On the day of the experiment, the device was washed by TBS buffer.

Cell Preparation

Human U87 cells and mouse 3T3 cells were live stained respectively with 4 uM green (C3100MP, ThermoFisher Scientific) and orange-red (C34851, ThermoFisher Scientific) live stain dyes in cell culture media (10% FBS in DMEM) in a 37° C. incubator for 15 minutes. The cells were then dissociated into single cell suspension in separate colonial tubes using 0.25% Trypsin-EDTA (25200-072, Life Technologies), re-suspended in TBS, and counted.

Cell Loading and Imaging

The two cell lines were then mixed at 1:1 ratio and diluted into 1000 total cells/uL concentration. 20 uL diluted mixed species cell suspension was then pipetted into the microwell array flow cell device and incubated for 3 minutes. Any uncaptured cells were flushed out by a TBS buffer wash. The cell-loaded device was then scanned in three channels including bright field, green, and orange channels.

Reagent Preparation for scRNA-Seq Library Prep

While the device was being scanned, fresh lysis buffer (1% 2-Mercaptoethanol, 99% Buffer TCL (1031576, Qiagen)), RNase inhibitor doped wash buffer (0.02 U/uL SUPERaseIN (AM2696, Thermo Fisher Scientific) in wash buffer), reverse transcription (RT) reaction mix (1× Maxima RT buffer, 1 Mm dNTPs, 1 U/uL SUPERaseIN, 2.5 uM template switch oligo (AAGCAGTGGTAT-CAACGCAGAGTGAATrGrGrG (SEQ ID NO: 9694), IDT), 10 U/uL Maxima H Minus reverse transcriptase (EP0752, Thermo Fisher Scientific), 0.1% Tween-20), and perfluorinated oil (F3556-25ML, Sigma-Aldrich) were prepared and loaded into their designated reservoirs on an automated reagent delivery/temperature control system as described before (Yuan & Sims, Scientific Reports 6, 33883 (2016)). The perfluorinated oil, lysis buffer, wash buffer reagent channels were primed by sequentially turning on the channels for 10 seconds, 10 seconds, and 30 seconds, respectively.

Bead Loading

After the device scan was completed, about 20000 of dual-barcoded mRNA capture beads were re-suspended in 30 uL of TBS buffer and then loaded into the device. Gentle flow (<3 uL/s) were used for the bead loading and all subsequent fluid exchange in the device to minimize cell and bead loss. Bead suspension was circulated through the device 5 to 10 times to achieve a high bead loading rate (defined as the fraction of wells having a bead) and a high bead capture efficiency (defined as the fraction of beads captured in the wells). Uncaptured beads were then washed out by a TBS buffer wash.

Automated Cell Lysis, mRNA Capture, cDNA Synthesis and Barcoding

The cell/bead loaded device was then connected to the system for the automated cell lysis, mRNA capture, and cDNA synthesis and barcoding. The device was temporarily disconnected from the fluidic system, scanned on a fluorescence microscope, and then reconnected to the fluidic system. Fluorescent signal from the stained cell lysate is used to check sealing integrity and the completeness of cell lysis.

Removal of Unused Capture Primers by Exo-I Digestion

When reverse transcription reaction was completed, the device was washed with wash buffer, refilled with Exo-I reaction mixture (1×Exo-I buffer, 1 U/uL Exo-I (M0293L, NEB)), and incubated at 37° C. for 45 minutes, cooled down to room temperature, and washed with TE/TW buffer.

Sequential Fluorescence Hybridization

The device was then connected to an automated reagent delivery/scanning system for 12 rounds of sequential fluorescence hybridization in order to measure the presence of each of the 12 optical barcode oligoes on each bead in the device. Cy5-labeled oligoes whose sequences are complementary to the ligated optical barcode oligoes were used as the read-out probes. During each round of fluorescence hybridization, the device was first scanned in both bright field and the Cy5 probe channel. 200 nM probe diluted in wash buffer was then flowed into the device, followed by a 10-minute incubation step. Unbound probe molecules were then washed out using wash buffer. The device was scanned again in both bright field and Cy5 probe channel. 150 mM NaOH in water was then flowed into the device, followed by a 10-minute incubation step. Detached probe molecules were then washed out using wash buffer, which concludes one round of fluorescence hybridization.

Bead Extraction

Once all 12 rounds of fluoresce hybridization were complete, the device was cut evenly into multiple pieces using a razor blade such that each piece contained about 400 cell/bead pairs. The pieces were processed in parallel in separate reaction tubes. Beads in each piece were extracted by a 30-second gentle water bath sonication in ethanol followed by a 1-minute centrifugation at 200 g. The extracted beads were then washed with 1 mL 150 mM NaOH, 1 mL TE/TW buffer, and 1 mL water.

Pre-Amplification of Full-Length cDNA

The small pieces of device were then assembled together and scanned to identify the borderlines between the small pieces. Beads from each piece were split into four 50 uL PCR reactions that contains 25 uL of 2× Kapa HiFi Hotstart Readymix (KK2601, Kapabiosystems), 0.5 uL 100 uM SMRTpcr primer (AAGCAGTGGTATCAACGCAGAGT (SEQ ID NO: 9696), IDT), and 24.5 uL of water. The mixtures were subjected to a PCR amplification protocol on a thermocycler (95° C. 3 minutes, 4 cycles of (98° C. 20 seconds, 65° C. 45 seconds, 72° C. 3 minutes), 8 cycles of (98° C. 20 seconds, 67° C. 20 seconds, 72° C. 3 minutes), 72° C. 5 minutes, hold at 4° C.). SMRT PCR product (supernatant only) of beads from each small piece were pooled together and purified using the SPRI paramagnetic bead technology (A63880, Beckman Coulter) with a 0.6:1 bead-to-sample volume ratio and eluted in 10 uL of nuclease free water. The purified products were then quantified by a fluorimeter.

Amplification and Sequencing of Tagmented cDNA

Purified product from each of the small piece was tagmented, barcoded, and amplified using a commercially available kit (Nextera XT, FC-131-1024, Illumina) per the vendor's instructions with the following modifications. First, 0.6 ng was used as input for each reaction. Second, a custom P5 primer (AATGATACGGCGAC-CACCGAGATCTACACGCCTGTCCGCG-GAAGCAGTGGTATC AACGCAGAGT*A*C (SEQ ID NO: 9692), IDT) was used in the PCR amplification. The Nextera PCR products were then pooled and purified twice using the SPRI paramagnetic bead technology (A63880, Beckman Coulter) with a 0.6:1 and 1:1 bead-to-sample volume ratios in the first and second round of purification respectively. The purified Nextera PCR product was sequenced on a NextSeq 500 machine (Illumina) with a custom read 1 sequencing primer (GCCTGTCCGCG-GAAGCAGTGGTATCAACGCAGAGTAC (SEQ ID NO: 9695), IDT). 21 bases were sequenced on read 1 and 63 bases were sequenced on read 2. The raw fastq files generated by sequencers were processed to obtain a digital expression matrix where each column represents the expression profile of a cell and each row represents the expression level of a gene for cells from each of the small pieces. The look-up table generated in the bead synthesis step was then used to link each cell's imaging phenotype to sequencing barcode sequence of the bead that resided in the same well with the cell and the associated mRNA expression profile.

Example 5

Merged Barcode for Sequence/Microscope

In the dual barcode embodiment described in previous examples, the mRNA capture beads contain two barcodes. The first barcode (sequencing barcode) becomes associated with the cDNA library obtained from each individual cell and distinguishes the cDNA from each cell on the sequencer. The second barcode (optical barcode) is used to identify the same cell by imaging with a microscope. Having two separate barcodes requires two manufacturing steps to synthesize the beads. Having two separate barcodes also requires a separate sequencing experiment to determine which optical barcode is attached to each sequencing barcode, as these are associated randomly in the synthesis process. To avoid these complications, an embodiment is provided wherein the sequencing barcode and the optical barcode are merged into the same entity.

In the dual barcode embodiment described in previous examples, the optical barcode is attached to a subset of the mRNA capture sites (poly-dT sequences) on each bead. This reduces the number of sites available for mRNA capture and therefore efficiency. This problem is avoided by making the sequencing barcode and optical barcode the same entity, because the resulting merged barcode can be located upstream of the mRNA capture site and does not have to be attached to its 3'-end, which ablates its ability to prime cDNA synthesis.

In the dual barcode embodiment described in previous examples, because only a subset of mRNA capture sites on each bead can be occupied by an optical barcode, the fluorescence signal obtainable from the optical barcode is relatively low. The fluorescence signal is improved by making the sequencing barcode and optical barcode the same entity, since the resulting merged barcode can be located upstream of the mRNA capture site and 100% of oligonucleotides on the bead can contain an optical barcode.

The merged barcode permits a simpler manufacturing process for optically barcoded mRNA capture beads, yields higher signal-to-noise allowing use of simpler microscopy equipment, and provides higher-quality scRNA-seq data.

The merged barcodes can be characterized by three parameters: N, M, and L. Each merged barcode contains N oligonucleotide sequence blocks. There is a unique set of M oligonucleotide sequences, each of length L nucleotides for each of the N blocks. For each sequence block on each bead, an oligonucleotide sequence is selected from the corresponding set of M oligonucleotide sequences. For example, for a given bead, the oligonucleotide sequence of block 1 would be chosen from the first set of M oligonucleotide sequences and the oligonucleotide sequence of block 2 would be chosen from the second set of M oligonucleotide sequences, etc. In this way, one can combinatorially generate a set of M^N unique merged barcodes from M×N oligonucleotide sequences. For example, if M=100 and N=2, one could generate 100^2=10,000 unique merged barcodes from 2 sets of 100 oligonucleotide sequences (M×N=100×2=200 total oligonucleotide sequences). If sequential fluorescence hybridization is to be used as a read-out, then it is convenient for all M×N oligonucleotide sequences to be unique. However, if sequencing is to be used as a read-out, then one could have, for example, identical sets of M oligonucleotide sequences for each block because the positional information afforded by sequencing could be used to distinguish the N oligonucleotide sequence blocks.

One approach to manufacturing beads conjugated to merged barcodes as described above is to use split-pool ligation of oligonucleotides. Consider the case that N=2 and M=96. One would purchase a 96-well plate of unique, 5'-phosphorylated oligonucleotides for each of the two sequence blocks in the barcode. One would then take beads conjugated to a universal oligonucleotide sequence adapter and add them to each well of the first 96-well plate along with reagents for DNA ligation (e.g., DNA ligase, an appropriate buffer, ATP). This set of 96 reactions would produce a library of beads conjugated to 96 different oligonucleotide sequences. Next, one would mix all of the beads from all 96 wells together in a single vessel and then add an equal proportion of the resulting pool to each of the 96 wells in the second plate of unique, 5'-phosphorylated oligonucleotides along with reagents for DNA ligation. At the end of this second reaction, one would again mix all of the beads from all 96 wells together in a single vessel. The second set of 96 reactions would produce a library of beads conjugated to 96^2=9,216 unique merged barcodes.

A second approach to manufacturing beads conjugated to merged barcodes as described above is to use split-pool solid-phase oligonucleotide synthesis. Consider again the case that N=2 and M=96. One would take beads conjugated to a universal oligonucleotide sequence adapter and split them into 96 wells. One would then use solid-phase (e.g., phosphoramidite-based) oligonucleotide synthesis to synthesize a unique oligonucleotide sequence onto the end of the universal oligonucleotide sequence adapters on the beads in each well. This set of 96 reactions would produce a library of beads conjugated to 96 different oligonucleotide sequences. Next, one would mix all of the beads from all 96 wells together in a single vessel and then add an equal proportion of the resulting pool to each of the 96 wells in the second plate. In the second plate, one would again use solid-phase (e.g., phosphoramidite-based) oligonucleotide synthesis to synthesize a unique oligonucleotide sequence onto the end of the first barcode sequence block that had been added to each bead in the first plate. At the end of this second reaction, one would again mix all of the beads from all 96 wells together in a single vessel. The second set of 96 reactions would produce a library of beads conjugated to 96^2=9,216 unique merged barcodes.

Figure 22:
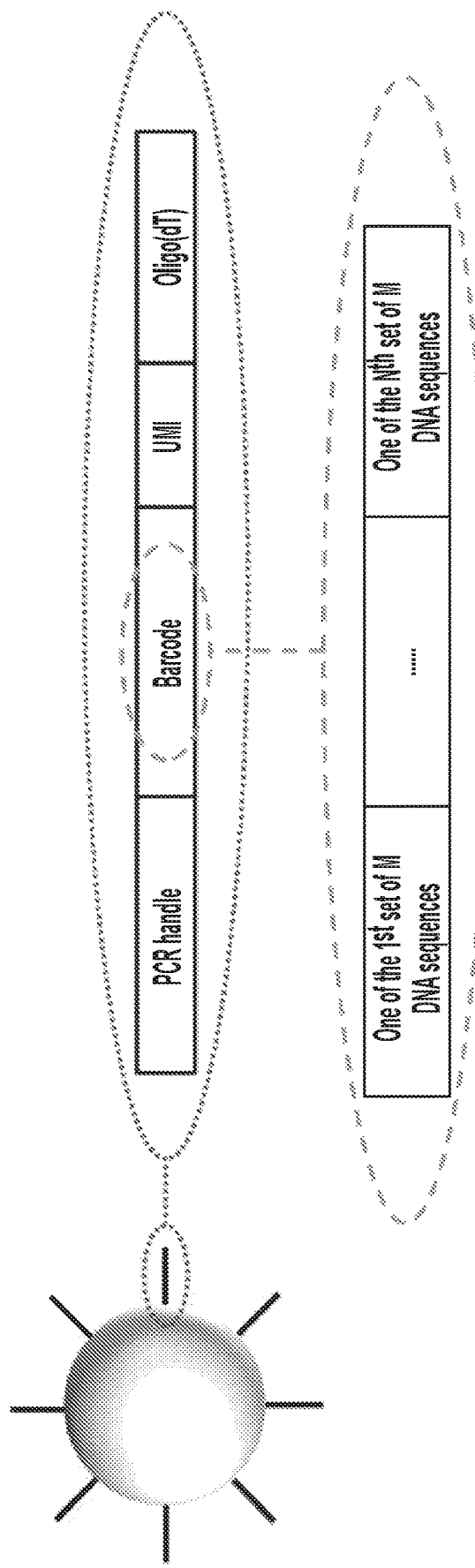
FIG. 22 illustrates bead design for a merged barcode oligonucleotide, with oligonucleotides attached to optically barcoded mRNA capture beads that enable simultaneous sequencing-based and optical demultiplexing of the same barcode sequence.

FIG. 22 shows the simplified design of the optically barcoded mRNA capture beads for the merged barcode. Unlike the previously-described dual barcode embodiments, there is only one cell-identifying barcode located upstream of the oligo(dT) mRNA capture site. This merged barcode contains a unique combination of multiple sequence blocks.

As illustrated in FIG. 22, we have N sets of M DNA sequences from which the N sequence blocks on each bead are generated, and one DNA sequence from each set is concatenated to form a unique barcode for each bead. For example, if there were three sets of 24 DNA sequences, one could generate 24^3=13,824 unique barcodes. These barcodes can be demultiplexed optically using sequential fluorescence hybridization just as in the previous implementation with a few practical modifications.

Figure 23:
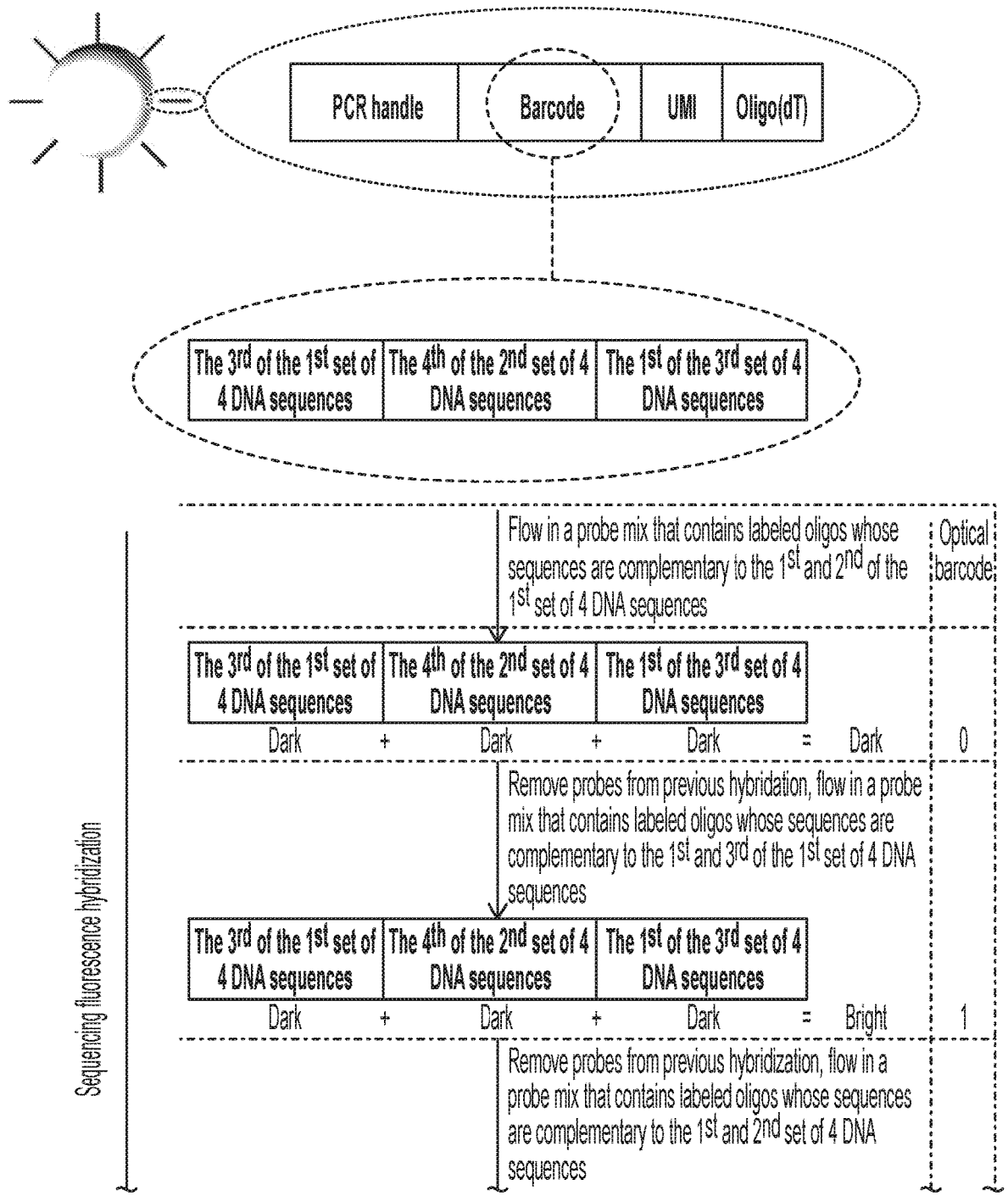
FIG. 23 is a schematic of optical demultiplexing by sequential fluorescence hybridization with combinatorial oligonucleotide pools (M=4, N=3) from merged barcode capture beads.
Figure 23:
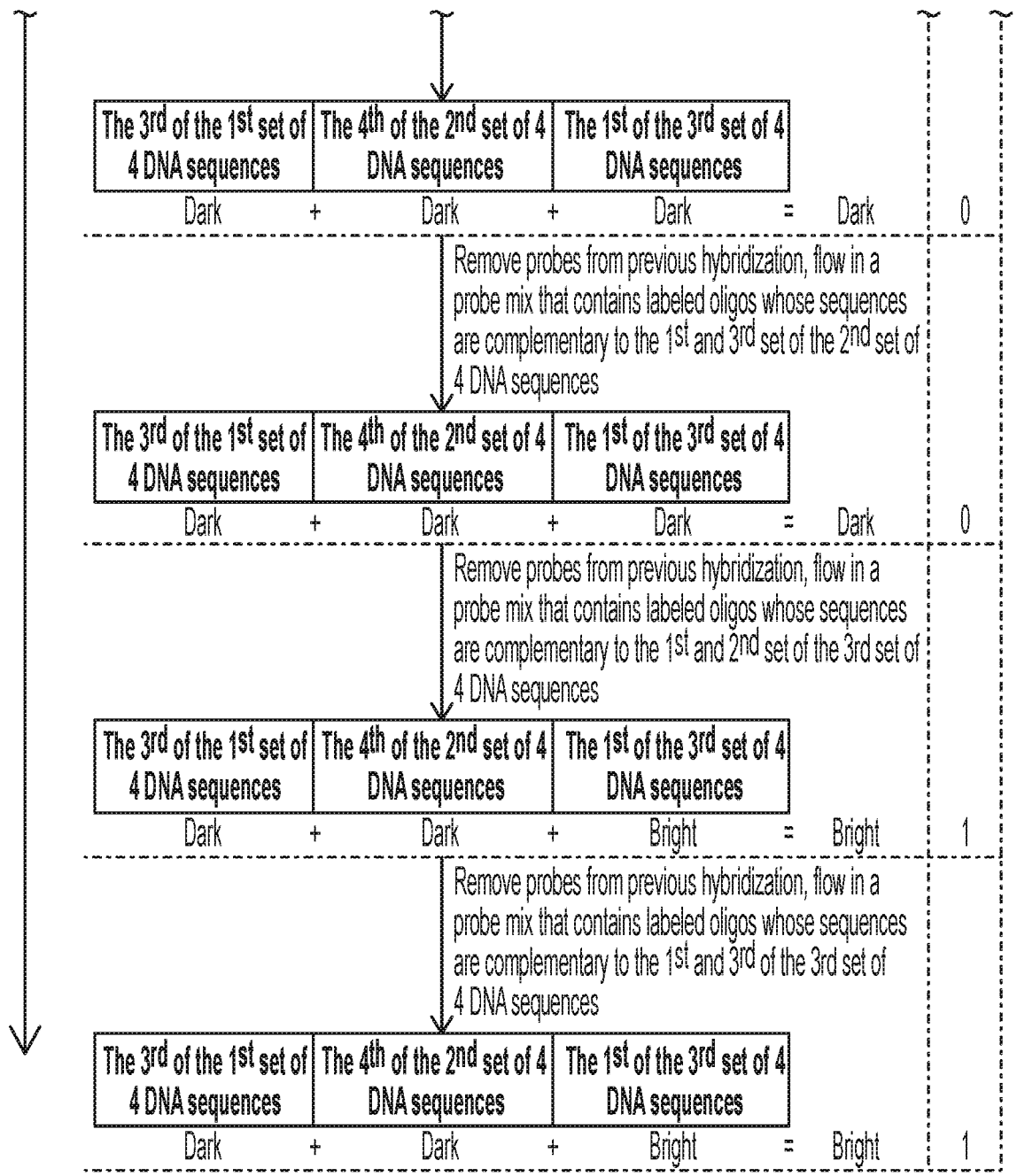

FIG. 23 illustrates an approach for optical demultiplexing of the beads illustrated in FIG. 22. In this scheme, the barcode is comprised of three concatenated sequence blocks (so N=3) and there are four sequences in each block (so M=4). For each of the three blocks, we introduce two mixtures of two probes to identify which of the four sequences are present in the block. For example, for the first block, first a mixture is introduced containing fluorescent probes that are complementary to sequences 1 and 2. Then a mixture is introduced containing fluorescent probes that are complementary to sequences 1 and 3. If sequence 3 is actually present on the bead, then the first mixture will give a negative result and the second will give a positive result. This outcome is unique to a bead harboring sequence 3 in its first block. This procedure is then repeat to identify the sequences in the remaining two blocks.

Optical demultiplexing of beads with the barcode format described in FIG. 22 and the readout method schematized in FIG. 23 is demonstrated. This approach avoids fluorescently labeling the large number of complementary probes directly. Instead, a universal sequence is included attached to each complementary probe that hybridizes to a universal fluorescently labeled oligonucleotide. This allows use of the same fluorescently labeled oligonucleotide to make all of the complementary probes fluorescent, which is highly cost effective. A representative image of fluorescence-based demultiplexing of a subset of the beads appears in FIG. 24.

Figure 24:
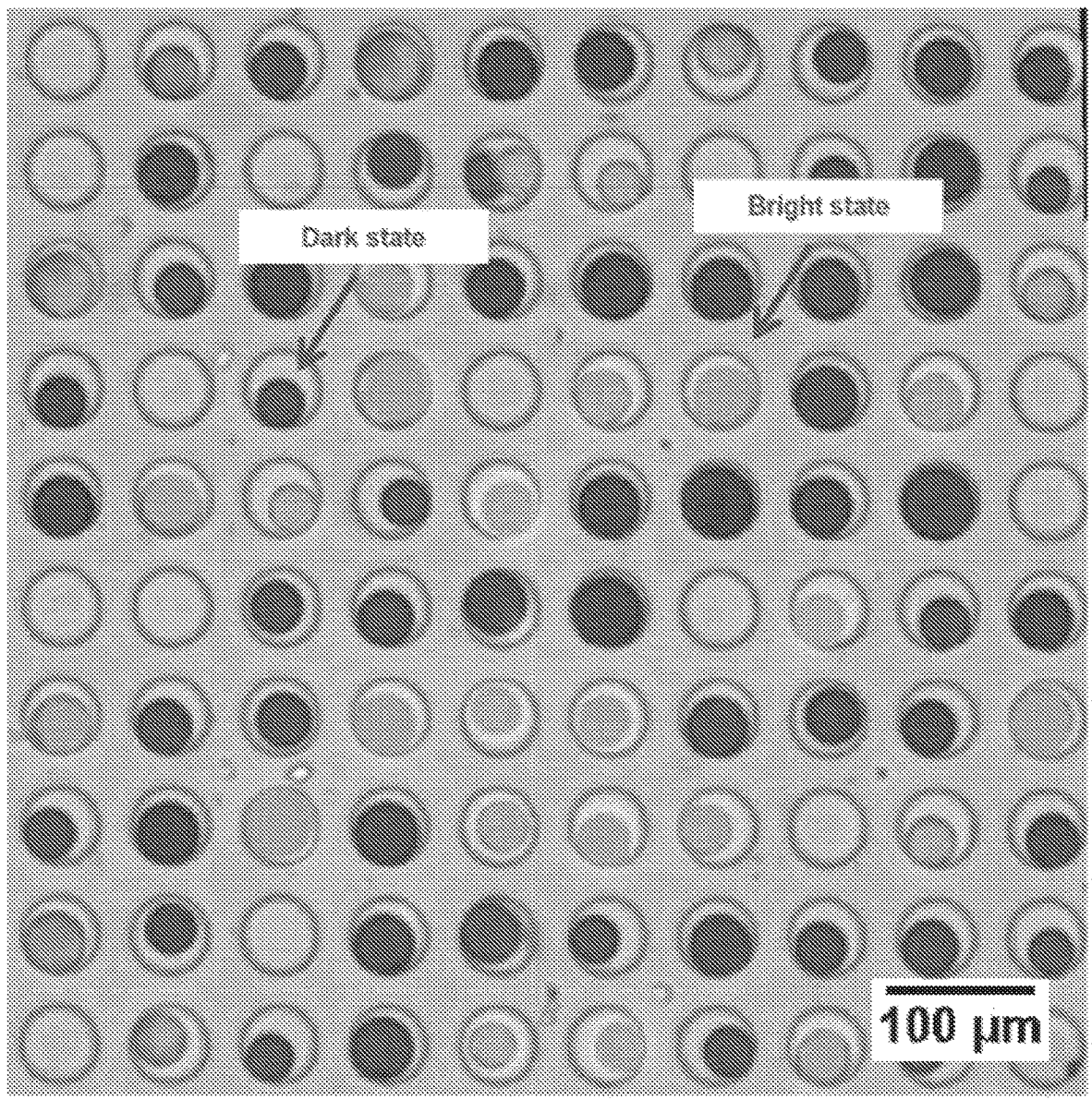
FIG. 24 is a fluorescence/bright field overlay image of microwell array filled with optically barcoded mRNA (merged barcode) capture beads during one cycle of optical demultiplexing, wherein as expected roughly half of the beads are highly fluorescent (bright state).

In the experiment that generated FIG. 24, barcoded beads with M=2 and N=3 were used. Initially followed is the microwell array-based single-cell RNA-Seq workflow described in Yuan and Sims, Scientific Reports 6, 33883, until the on-chip reverse transcription step. After the on-chip reverse transcription step, exonuclease I digestion reaction mix (1× Exo I buffer, 1 U/uL Exo I) is flowed in, and the device is incubated in a 37° C. incubator for 45 minutes. This step removes unused single-stranded capture primers that were accessible to enzymatic digestion. The device was then washed by TE/TW buffer (10 mM Tris pH8.0, 1 mM EDTA, 0.01% Tween-20). A hybridization mix (200 nM primary probe oligo, 20 mM Tris-HCl pH 7.9, 50 mM NaCl, 0.1% Tween-20) was subsequently flowed into the device and incubated for 10 minutes. The primary probe oligo is an unlabeled oligo whose sequence can be divided into two parts. One part of the oligo's sequence is complimentary to the first of the first set of two oligo sequences on the bead.

The other part's sequence is complimentary to a fluorescently labeled oligo which we call read-out probe. The device is then washed with wash buffer (20 mM Tris-HCl pH7.9, 50 mM NaCl, 0.1% Tween-20) to remove any unbound oligos. The read-out probe mix (200 nM read-out probe oligo, 20 mM Tris-HCl pH 7.9, 50 mM NaCl, 0.1% Tween-20) was then flowed into the device and incubated for 10 minutes. Unbound oligos were washed out by wash buffer afterwards. The device is then scanned under a microscope through both bright field and fluorescence channel which generated images like the ones shown in FIG. 24. Beads were then extracted from the device, washed with 150 mM NaOH, pooled together for subsequent tube-based library construction steps as described previously in Yuan and Sims (2016), Scientific Reports 6, 33883.

Merged Barcode mRNA Capture Beads (M=2, N=2)

To test the merged optical barcode scheme (SCOPE-seqV2), a small-scale pool of optically barcoded mRNA capture beads were designed with two concatenated sequence blocks (N=2) with two sequences in each block (M=2). The sequence in each block was eight bases long. This results in a total of four (2²=4) different bead species in the bead pool. The performance of these beads was characterized in 1) a single cell RNA-Seq experiment and 2) a fluorescence hybridization experiment.

Figure 25:
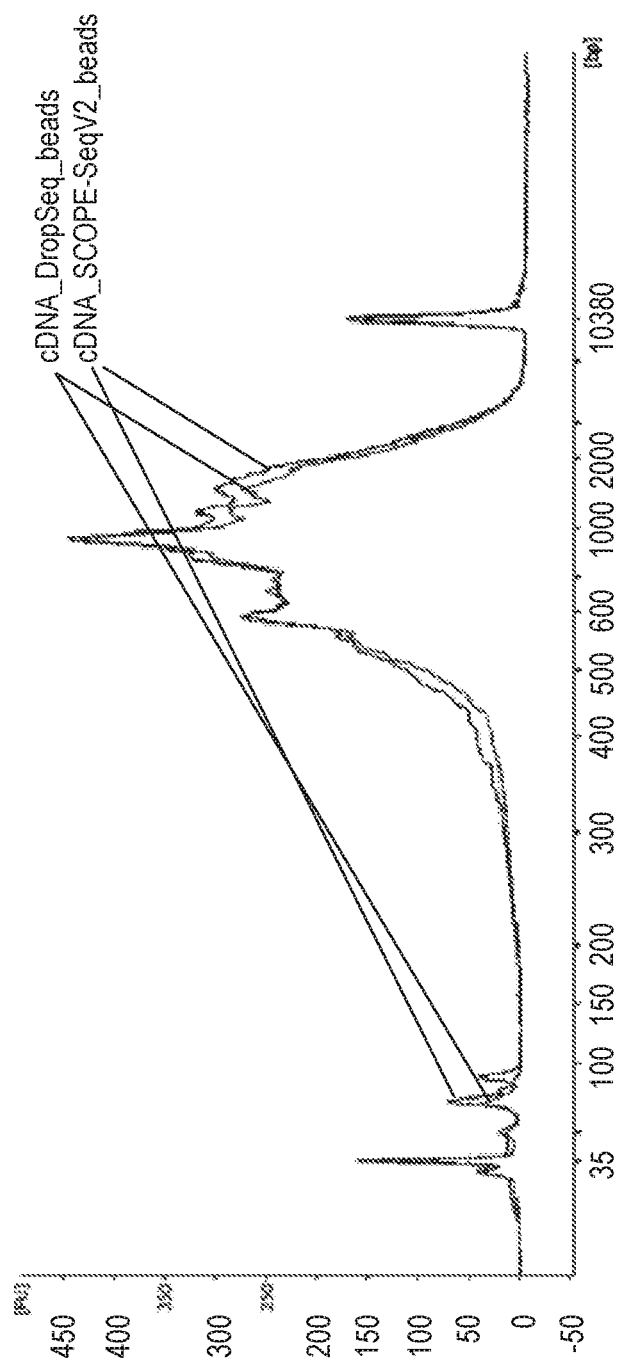
FIG. 25 is a length distribution of cDNA obtained using conventional RNA-seq beads and SCOPE-SeqV2 (merged barcode) beads measured on a high sensitivity bioanalyzer chip, showing almost identical results for the conventional RNA-seq and SCOPE-SeqV2 beads.

In the single cell RNA-Seq experiment, merged optically barcoded mRNA capture beads (referred as SCOPE-SeqV2 beads) and non-optically barcoded mRNA capture beads (referred as conventional RNA-seq beads) were used to perform single cell RNA-Seq in two separate microwell array devices on approximately (<20% difference) the same number of cells sampled from the same batch of cell culture using the protocol described in Yuan et al, Scientific Reports, 2016. Pre-amplified cDNA from both experiments were quantified by fluorometer (Qubit) and capillary gel electrophoresis (Bioanalyzer, Agilent). The amount of cDNA yield and cDNA length distribution were essentially identical for cDNA obtained using both types of beads (see FIG. 25). This observation suggests that capture efficiency for single-cell RNA-seq is uncompromised by this merged optical barcoding embodiment.

Figure 27:
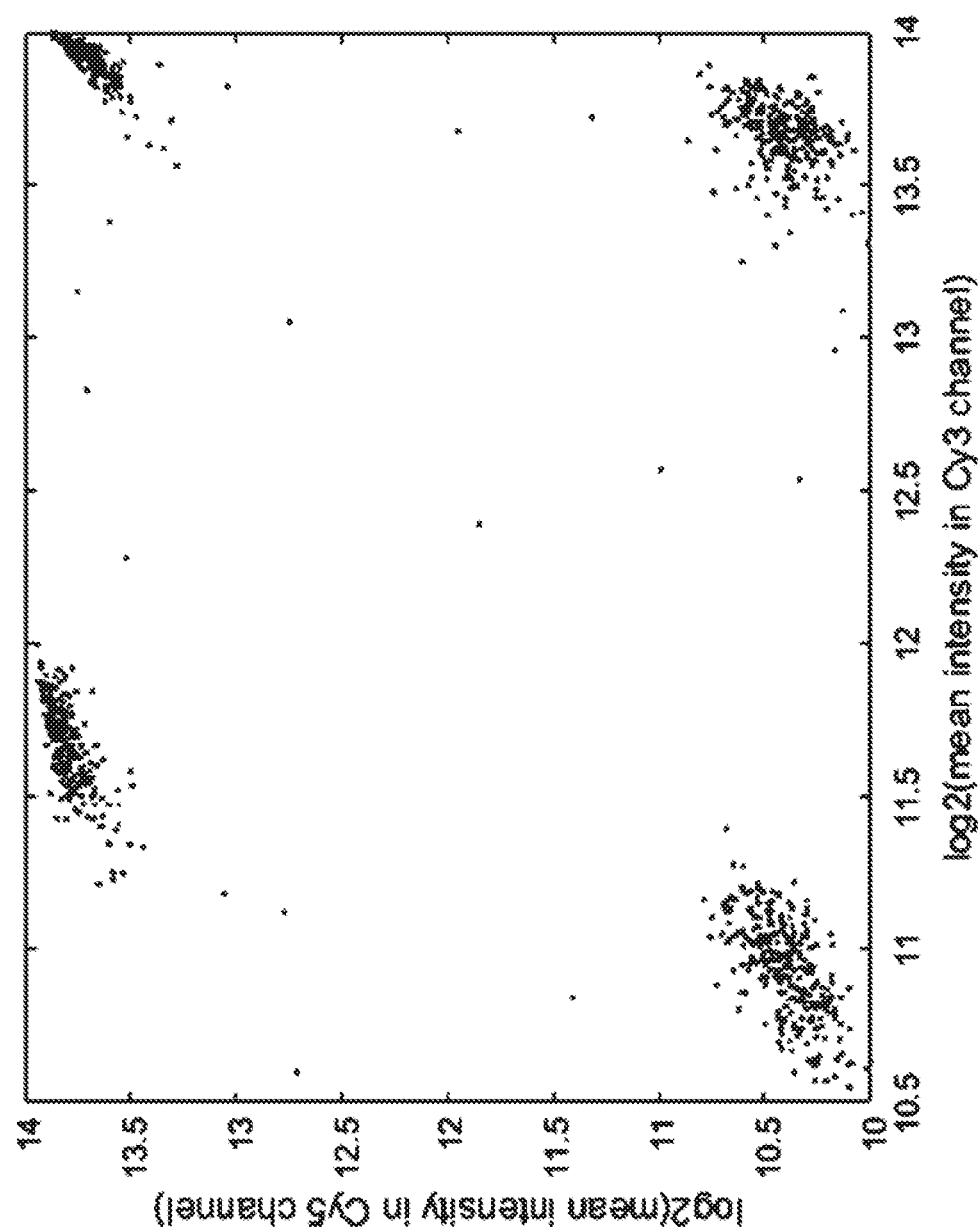
FIG. 27 is a scatter plot of the log 2 transformed mean intensities of individual beads in the Cy3 and Cy5 channels.

In the fluorescence hybridization experiment, exonuclease-treated SCOPE-SeqV2 beads were loaded into a microwell array device. A Cy3 dye-labeled 8-mer oligonucleotide whose sequence is complimentary to one of the two sequences in the first sequence block and Cy5 dye-labeled 8-mer oligonucleotide whose sequence is complimentary to one of the two sequences in the second sequence block were simultaneously hybridized to the beads in the microwell array device. Both oligonucleotides were introduced at a concentration of 100 nM in a hybridization buffer comprised of 2×SSC (Saline Sodium Citrate) with 10% DMSO (Dimethyl sulfoxide) and an incubation time of 10 minutes. Next, excess oligonucleotides were rinsed out of the device by laminar flow of buffer. Beads in microwell array device were then imaged in the Cy3 and Cy5 excitation/emission channels with an epifluorescence microscope, and a bright field transmission image was also acquired. A multi-color composite image of the beads (FIG. 26) clearly shows that there are four optically distinct bead species (pseudo-colored as black, green, orange, and red). A scatter plot of the log 2 transformed average bead intensity in the Cy3 and Cy5 channels (FIG. 27) demonstrates high signal-to-background ratio. Four bead populations can be readily detected.

Design Considerations for Merged Barcode Beads

In one embodiment, the length of the sequence in each merged optical barcode sequence block is long enough for stable oligonucleotide hybridization at room temperature but not too long to minimize DNA secondary structure. The formation of DNA secondary structure significantly compromises the quality of scRNA-Seq data and fluorescence hybridization-based optical demultiplexing. Typically, fluorescence probes with a length between 16 nt and 22 nt are used in fluorescence hybridization-based applications including single molecule fluorescence in situ hybridization. However, when 16 nt oligonucleotides were used in each optical barcode sequence block, scRNA-Seq data and optical demultiplexing were both significantly adversely affected. When 8 nt oligonucleotides were used in each optical barcode sequence block, uncompromised scRNA-Seq data (compared to conventional RNA-seq beads) and fluorescence hybridization signal with high signal-to-background ratio were obtained. Therefore, the length of optical barcode sequence in each block was set to be 8 nt.

To distinguish different optical barcode sequences using fluorescence hybridization, a preliminary list of 8-mer sequences was generated that are at least 3 Levenshtein distance away from each other. Any sequences that contain 3-base homopolymers or whose GC content is either <40% or >60%, or are perfectly self-complementary were filtered out. This constrains the oligonucleotide sequence space to 547 8-mer sequences (out of a possible 4^8=65,536).

A preliminary list of full-length mRNA capture oligonucleotide sequences was then generated by combinatorically arranging these 8-mer sequences in two optical barcode oligonucleotide sequence blocks separated by two random unique molecular identifier (UMI) bases. The composition of the full-length sequence is as follows:

TTTTTTTAAGCAGTGGTATCAACGCAGAGTACNN (8-mer Block 1)NN(8-mer Block 2)NNTTTTTTTTTTTTTTTTTTTTTTTTTTTTTT (SEQ ID NO: 9696)

The maximum length of continuous self-complimentary sequences within each full-length mRNA capture oligonucleotide sequence is calculated. The stability score of such self-complimentary structure is defined as $1.5*L_{GC}+L_{AT}$, wherein $L_{GC}$ and $L_{AT}$ are the number of GC bases and AT bases respectively in the continuous stretch of self-complimentary sequence. The individual 8-mer sequences were then ranked in ascending order by the sum of the stability score of all full-length sequences of which it was a member. The bottom 50% of the 8-mer sequences on this ranked list was filtered out leaving 274 8-mer sequences.

Another round of filtering is performed on this list based on the melting temperature and self-dimer or cross-dimer forming potential. Any 8-mer sequences with a predicted melting temperature below 25° C. or a strong tendency to form self-dimer or cross-dimer were excluded. 11 and 17 8-mer sequences were filtered out due to low melting temperature and strong potential to form self-dimer or cross-dimer respectively leaving 246 8-mer sequences (see attached sequence listing).

The 8-mer sequences also need to be highly distinct from the universal sequence adapters at the base of each bead (TTTTTTTAAGCAGTGGTATCAACGCAGAGTAC (SEQ ID NO: 9697)). The local alignment scores between all remaining 8-mer sequences and the universal sequence were calculated. The remaining 8-mer sequences were then ranked based on this local alignment score in ascending order. The top 96 8-mer sequences were used in the first optical barcode oligonucleotide sequence block. The 97$^{th}$ to 192$^{nd}$ 8-mer sequences were used in the second optical barcode oligonucleotide sequence block. A final list of 9216 full-length mRNA capture oligonucleotide sequences was then generated (see attached sequence listing).

SEQUENCE LISTING (9696 sequences)

SEQ ID NO: 1 - DNA, 8 bp, Artificial sequence
  Synthetic
gattggag

SEQ ID NO: 2 - DNA, 8 bp, Artificial sequence
  Synthetic
gattggag

SEQ ID NO: 3 - DNA, 8 bp, Artificial sequence
  Synthetic
ggatgaag

SEQ ID NO: 4 - DNA, 8 bp, Artificial sequence
  Synthetic
tggaggat

SEQ ID NO: 5 - DNA, 8 bp, Artificial sequence
  Synthetic
aggtaagg

SEQ ID NO: 6 - DNA, 8 bp, Artificial sequence
  Synthetic
ggaacttg

SEQ ID NO: 7 - DNA, 8 bp, Artificial sequence
  Synthetic
ggttagtg

SEQ ID NO: 8 - DNA, 8 bp, Artificial sequence
  Synthetic
ggagttag

SEQ ID NO: 9 - DNA, 8 bp, Artificial sequence
  Synthetic
tgtgtgtg

SEQ ID NO: 10 - DNA, 8 bp, Artificial sequence
  Synthetic
tggcctaa

SEQ ID NO: 11 - DNA, 8 bp, Artificial sequence
  Synthetic
tcggacaa

SEQ ID NO: 12 - DNA, 8 bp, Artificial sequence
  Synthetic
attgtccg

SEQ ID NO: 13 - DNA, 8 bp, Artificial sequence
  Synthetic
tgtccgat

SEQ ID NO: 14 - DNA, 8 bp, Artificial sequence
  Synthetic
gctattcg

SEQ ID NO: 15 - DNA, 8 bp, Artificial sequence
  Synthetic
agcctaac

SEQ ID NO: 16 - DNA, 8 bp, Artificial sequence
  Synthetic
gcctatct

SEQ ID NO: 17 - DNA, 8 bp, Artificial sequence
  Synthetic
tggtgaga

SEQ ID NO: 18 - DNA, 8 bp, Artificial sequence
  Synthetic
cgatctag

SEQ ID NO: 19 - DNA, 8 bp, Artificial sequence
  Synthetic
gtgtatgg

SEQ ID NO: 20 - DNA, 8 bp, Artificial sequence
  Synthetic
ccggttaa

SEQ ID NO: 21 - DNA, 8 bp, Artificial sequence
  Synthetic
ttgttcgg

SEQ ID NO: 22 - DNA, 8 bp, Artificial sequence
  Synthetic
gatcttgg

SEQ ID NO: 23 - DNA, 8 bp, Artificial sequence
  Synthetic
gtgaggaa

SEQ ID NO: 24 - DNA, 8 bp, Artificial sequence
  Synthetic
aggagatg

SEQ ID NO: 25 - DNA, 8 bp, Artificial sequence
  Synthetic
aaggccta

SEQ ID NO: 26 - DNA, 8 bp, Artificial sequence
  Synthetic
cgtaatcg

SEQ ID NO: 27 - DNA, 8 bp, Artificial sequence
  Synthetic
tgagaagg

SEQ ID NO: 28 - DNA, 8 bp, Artificial sequence
  Synthetic
gtcgatgt

SEQ ID NO: 29 - DNA, 8 bp, Artificial sequence
  Synthetic
gaaggact

SEQ ID NO: 30 - DNA, 8 bp, Artificial sequence
  Synthetic
gtagacct

SEQ ID NO: 31 - DNA, 8 bp, Artificial sequence
  Synthetic
caattggc

SEQ ID NO: 32 - DNA, 8 bp, Artificial sequence
  Synthetic
tcgaatgg

SEQ ID NO: 33 - DNA, 8 bp, Artificial sequence
  Synthetic
aaggtgca

SEQ ID NO: 34 - DNA, 8 bp, Artificial sequence
  Synthetic
acgatcga

SEQ ID NO: 35 - DNA, 8 bp, Artificial sequence
  Synthetic
agaatcgg

SEQ ID NO: 36 - DNA, 8 bp, Artificial sequence
  Synthetic
ggaatgga

SEQ ID NO: 37 - DNA, 8 bp, Artificial sequence
  Synthetic
ccgtattg

SEQ ID NO: 38 - DNA, 8 bp, Artificial sequence
  Synthetic
aaggaggt

SEQ ID NO: 39 - DNA, 8 bp, Artificial sequence
  Synthetic
ctggaatg

SEQ ID NO: 40 - DNA, 8 bp, Artificial sequence
  Synthetic
acgacttg

SEQ ID NO: 41 - DNA, 8 bp, Artificial sequence
  Synthetic
gttcgaga

SEQ ID NO: 42 - DNA, 8 bp, Artificial sequence
  Synthetic
tcctaggt

SEQ ID NO: 43 - DNA, 8 bp, Artificial sequence
  Synthetic
gatgacga

SEQ ID NO: 44 - DNA, 8 bp, Artificial sequence
  Synthetic
atgtcgag

SEQ ID NO: 45 - DNA, 8 bp, Artificial sequence
  Synthetic
aacgtgtc

SEQ ID NO: 46 - DNA, 8 bp, Artificial sequence
  Synthetic
ggtcagaa

SEQ ID NO: 47 - DNA, 8 bp, Artificial sequence
  Synthetic
gagtcgat

SEQ ID NO: 48 - DNA, 8 bp, Artificial sequence
  Synthetic
gatggtgt

SEQ ID NO: 49 - DNA, 8 bp, Artificial sequence
  Synthetic
agaaggtc

SEQ ID NO: 50 - DNA, 8 bp, Artificial sequence
  Synthetic
aggatgac

SEQ ID NO: 51 - DNA, 8 bp, Artificial sequence
  Synthetic
ggtaggta

SEQ ID NO: 52 - DNA, 8 bp, Artificial sequence
  Synthetic
gacaagtg

SEQ ID NO: 53 - DNA, 8 bp, Artificial sequence
  Synthetic
taggaagc

SEQ ID NO: 54 - DNA, 8 bp, Artificial sequence
  Synthetic
ttcaggag

SEQ ID NO: 55 - DNA, 8 bp, Artificial sequence
  Synthetic
gtcatagg

SEQ ID NO: 56 - DNA, 8 bp, Artificial sequence
  Synthetic
gaacggaa

SEQ ID NO: 57 - DNA, 8 bp, Artificial sequence
  Synthetic
aatggacg

SEQ ID NO: 58 - DNA, 8 bp, Artificial sequence
  Synthetic
atcggaag

SEQ ID NO: 59 - DNA, 8 bp, Artificial sequence
  Synthetic
aagacgga

SEQ ID NO: 60 - DNA, 8 bp, Artificial sequence
  Synthetic
actaaccg

SEQ ID NO: 61 - DNA, 8 bp, Artificial sequence
  Synthetic
gtgcacaa

SEQ ID NO: 62 - DNA, 8 bp, Artificial sequence
  Synthetic
cctatcca

SEQ ID NO: 63 - DNA, 8 bp, Artificial sequence
  Synthetic
cttggaca

SEQ ID NO: 64 - DNA, 8 bp, Artificial sequence
  Synthetic
tggtcaag

SEQ ID NO: 65 - DNA, 8 bp, Artificial sequence
  Synthetic
gaatgagc

SEQ ID NO: 66 - DNA, 8 bp, Artificial sequence
  Synthetic
gaggagaa

SEQ ID NO: 67 - DNA, 8 bp, Artificial sequence
  Synthetic
gagatggt

SEQ ID NO: 68 - DNA, 8 bp, Artificial sequence
  Synthetic
gaagtagg

SEQ ID NO: 69 - DNA, 8 bp, Artificial sequence
  Synthetic
cggcatat

SEQ ID NO: 70 - DNA, 8 bp, Artificial sequence
  Synthetic
cggaagaa

SEQ ID NO: 71 - DNA, 8 bp, Artificial sequence
  Synthetic
attggtgc

SEQ ID NO: 72 - DNA, 8 bp, Artificial sequence
  Synthetic
ggtggatt

SEQ ID NO: 73 - DNA, 8 bp, Artificial sequence
  Synthetic
ggctaaga

SEQ ID NO: 74 - DNA, 8 bp, Artificial sequence
  Synthetic
ttagaggc

SEQ ID NO: 75 - DNA, 8 bp, Artificial sequence
  Synthetic
ccattgtg

SEQ ID NO: 76 - DNA, 8 bp, Artificial sequence
  Synthetic
cgagattg

SEQ ID NO: 77 - DNA, 8 bp, Artificial sequence
  Synthetic
tgtggaag

SEQ ID NO: 78 - DNA, 8 bp, Artificial sequence
  Synthetic
tcttgtgg

SEQ ID NO: 79 - DNA, 8 bp, Artificial sequence
  Synthetic
ccttcaga

SEQ ID NO: 80 - DNA, 8 bp, Artificial sequence
  Synthetic
cctcatgt

SEQ ID NO: 81 - DNA, 8 bp, Artificial sequence
  Synthetic
ggagtgtt

SEQ ID NO: 82 - DNA, 8 bp, Artificial sequence
  Synthetic
gaagatcc

SEQ ID NO: 83 - DNA, 8 bp, Artificial sequence
  Synthetic
agtggaga

SEQ ID NO: 84 - DNA, 8 bp, Artificial sequence
  Synthetic
tagtagcc

SEQ ID NO: 85 - DNA, 8 bp, Artificial sequence
  Synthetic
gagatcag

SEQ ID NO: 86 - DNA, 8 bp, Artificial sequence
  Synthetic
tgaaggca

SEQ ID NO: 87 - DNA, 8 bp, Artificial sequence
  Synthetic
tccgatga

SEQ ID NO: 88 - DNA, 8 bp, Artificial sequence
  Synthetic
acgaatcc

SEQ ID NO: 89 - DNA, 8 bp, Artificial sequence
  Synthetic
taagaccg

SEQ ID NO: 90 - DNA, 8 bp, Artificial sequence
  Synthetic
tctatggc

SEQ ID NO: 91 - DNA, 8 bp, Artificial sequence
  Synthetic
caaggatg

SEQ ID NO: 92 - DNA, 8 bp, Artificial sequence
  Synthetic
tcagaacc

SEQ ID NO: 93 - DNA, 8 bp, Artificial sequence
  Synthetic
tcatgtcc

SEQ ID NO: 94 - DNA, 8 bp, Artificial sequence
  Synthetic
acaagacc

SEQ ID NO: 95 - DNA, 8 bp, Artificial sequence
  Synthetic
gttagacg

SEQ ID NO: 96 - DNA, 8 bp, Artificial sequence
  Synthetic
ctggtgta

SEQ ID NO: 97 - DNA, 8 bp, Artificial sequence
  Synthetic
tagacgac

SEQ ID NO: 98 - DNA, 8 bp, Artificial sequence
  Synthetic
aatcggca

SEQ ID NO: 99 - DNA, 8 bp, Artificial sequence
  Synthetic
tacggcat

SEQ ID NO: 100 - DNA, 8 bp, Artificial sequence
  Synthetic
ttggatcg

SEQ ID NO: 101 - DNA, 8 bp, Artificial sequence
  Synthetic
tggaacga

SEQ ID NO: 102 - DNA, 8 bp, Artificial sequence
  Synthetic
ggcaatca

SEQ ID NO: 103 - DNA, 8 bp, Artificial sequence
  Synthetic
gaatccga

SEQ ID NO: 104 - DNA, 8 bp, Artificial sequence
  Synthetic
ttacggtg

SEQ ID NO: 105 - DNA, 8 bp, Artificial sequence
  Synthetic
catatcgg

SEQ ID NO: 106 - DNA, 8 bp, Artificial sequence
  Synthetic
cttcggta

SEQ ID NO: 107 - DNA, 8 bp, Artificial sequence
  Synthetic
tcctaacg

SEQ ID NO: 108 - DNA, 8 bp, Artificial sequence
  Synthetic
gtaagcca

SEQ ID NO: 109 - DNA, 8 bp, Artificial sequence
  Synthetic
taaggtgg

SEQ ID NO: 110 - DNA, 8 bp, Artificial sequence
  Synthetic
ggtaagct

SEQ ID NO: 111 - DNA, 8 bp, Artificial sequence
  Synthetic
tgtgtcga

SEQ ID NO: 112 - DNA, 8 bp, Artificial sequence
  Synthetic
gagcatga

SEQ ID NO: 113 - DNA, 8 bp, Artificial sequence
  Synthetic
tcgaagtc

SEQ ID NO: 114 - DNA, 8 bp, Artificial sequence
  Synthetic
ggtgaaca

SEQ ID NO: 115 - DNA, 8 bp, Artificial sequence
  Synthetic
acatgcac

SEQ ID NO: 116 - DNA, 8 bp, Artificial sequence
  Synthetic
ccaacagt

SEQ ID NO: 117 - DNA, 8 bp, Artificial sequence
  Synthetic
agaacagc

SEQ ID NO: 118 - DNA, 8 bp, Artificial sequence
  Synthetic
gaacacgt

SEQ ID NO: 119 - DNA, 8 bp, Artificial sequence
  Synthetic
ggtcttca

SEQ ID NO: 120 - DNA, 8 bp, Artificial sequence
  Synthetic
aggttcag

SEQ ID NO: 121 - DNA, 8 bp, Artificial sequence
  Synthetic
ctagagca

SEQ ID NO: 122 - DNA, 8 bp, Artificial sequence
  Synthetic
cttctagc

SEQ ID NO: 123 - DNA, 8 bp, Artificial sequence
  Synthetic
gagtaacg

SEQ ID NO: 124 - DNA, 8 bp, Artificial sequence
  Synthetic
ctaagagg

SEQ ID NO: 125 - DNA, 8 bp, Artificial sequence
  Synthetic
acgtgtag

SEQ ID NO: 126 - DNA, 8 bp, Artificial sequence
  Synthetic
actacagg

SEQ ID NO: 127 - DNA, 8 bp, Artificial sequence
  Synthetic
tacaggtc

SEQ ID NO: 128 - DNA, 8 bp, Artificial sequence
  Synthetic
ctcacatg

SEQ ID NO: 129 - DNA, 8 bp, Artificial sequence
  Synthetic
actaggag

SEQ ID NO: 130 - DNA, 8 bp, Artificial sequence
  Synthetic
ccatagga

SEQ ID NO: 131 - DNA, 8 bp, Artificial sequence
  Synthetic
ggagaatc

SEQ ID NO: 132 - DNA, 8 bp, Artificial sequence
  Synthetic
gccaagaa

SEQ ID NO: 133 - DNA, 8 bp, Artificial sequence
  Synthetic
aaggcaag

SEQ ID NO: 134 - DNA, 8 bp, Artificial sequence
  Synthetic
aatgtcgc

SEQ ID NO: 135 - DNA, 8 bp, Artificial sequence
  Synthetic
atggaacc

SEQ ID NO: 136 - DNA, 8 bp, Artificial sequence
  Synthetic
agaggcat

SEQ ID NO: 137 - DNA, 8 bp, Artificial sequence
  Synthetic
tgcatagc

SEQ ID NO: 138 - DNA, 8 bp, Artificial sequence
  Synthetic
ctaacgga

SEQ ID NO: 139 - DNA, 8 bp, Artificial sequence
  Synthetic
tatcgagg

SEQ ID NO: 140 - DNA, 8 bp, Artificial sequence
  Synthetic
catagcct

SEQ ID NO: 141 - DNA, 8 bp, Artificial sequence
  Synthetic
atcgagac

SEQ ID NO: 142 - DNA, 8 bp, Artificial sequence
  Synthetic
ggaagagt

SEQ ID NO: 143 - DNA, 8 bp, Artificial sequence
  Synthetic
ccaagtag

SEQ ID NO: 144 - DNA, 8 bp, Artificial sequence
  Synthetic
ctgaacag

SEQ ID NO: 145 - DNA, 8 bp, Artificial sequence
  Synthetic
gtaggttc

SEQ ID NO: 146 - DNA, 8 bp, Artificial sequence
  Synthetic
gtatggac

SEQ ID NO: 147 - DNA, 8 bp, Artificial sequence
  Synthetic
tcgcaaca

SEQ ID NO: 148 - DNA, 8 bp, Artificial sequence
  Synthetic
ccgctaat

SEQ ID NO: 149 - DNA, 8 bp, Artificial sequence
  Synthetic
gattcgca

SEQ ID NO: 150 - DNA, 8 bp, Artificial sequence
  Synthetic
cgatggaa

SEQ ID NO: 151 - DNA, 8 bp, Artificial sequence
  Synthetic
agcaagga

SEQ ID NO: 152 - DNA, 8 bp, Artificial sequence
  Synthetic
cgtagcaa

SEQ ID NO: 153 - DNA, 8 bp, Artificial sequence
  Synthetic
tggcagta

SEQ ID NO: 154 - DNA, 8 bp, Artificial sequence
  Synthetic
cggtagtt

SEQ ID NO: 155 - DNA, 8 bp, Artificial sequence
  Synthetic
tgacttcg

SEQ ID NO: 156 - DNA, 8 bp, Artificial sequence
  Synthetic
gagtgcaa

SEQ ID NO: 157 - DNA, 8 bp, Artificial sequence
  Synthetic
acggtaac

SEQ ID NO: 158 - DNA, 8 bp, Artificial sequence
  Synthetic
aagtggtg

SEQ ID NO: 159 - DNA, 8 bp, Artificial sequence
  Synthetic
ggagacaa

SEQ ID NO: 160 - DNA, 8 bp, Artificial sequence
  Synthetic
tcaaggac

SEQ ID NO: 161 - DNA, 8 bp, Artificial sequence
  Synthetic
aagagagc

SEQ ID NO: 162 - DNA, 8 bp, Artificial sequence
  Synthetic
cgagagat

SEQ ID NO: 163 - DNA, 8 bp, Artificial sequence
  Synthetic
acagatgg

SEQ ID NO: 164 - DNA, 8 bp, Artificial sequence
  Synthetic
aggagtca

SEQ ID NO: 165 - DNA, 8 bp, Artificial sequence
  Synthetic
cgtgttac

SEQ ID NO: 166 - DNA, 8 bp, Artificial sequence
  Synthetic
tagtgtgc

SEQ ID NO: 167 - DNA, 8 bp, Artificial sequence
  Synthetic
ctcatgac

SEQ ID NO: 168 - DNA, 8 bp, Artificial sequence
  Synthetic
gtatccag

SEQ ID NO: 169 - DNA, 8 bp, Artificial sequence
  Synthetic
acgcctat

SEQ ID NO: 170 - DNA, 8 bp, Artificial sequence
  Synthetic
aacgacct

SEQ ID NO: 171 - DNA, 8 bp, Artificial sequence
  Synthetic
atcaggct

SEQ ID NO: 172 - DNA, 8 bp, Artificial sequence
  Synthetic
caagttcg

SEQ ID NO: 173 - DNA, 8 bp, Artificial sequence
  Synthetic
tagccaga

SEQ ID NO: 174 - DNA, 8 bp, Artificial sequence
  Synthetic
caatcacg

SEQ ID NO: 175 - DNA, 8 bp, Artificial sequence
  Synthetic
gcaacaag

SEQ ID NO: 176 - DNA, 8 bp, Artificial sequence
  Synthetic
cacgacaa

SEQ ID NO: 177 - DNA, 8 bp, Artificial sequence
  Synthetic
tacggaga

SEQ ID NO: 178 - DNA, 8 bp, Artificial sequence
  Synthetic
cgacaaga

SEQ ID NO: 179 - DNA, 8 bp, Artificial sequence
  Synthetic
cgaagtga

SEQ ID NO: 180 - DNA, 8 bp, Artificial sequence
  Synthetic
agctggta

SEQ ID NO: 181 - DNA, 8 bp, Artificial sequence
  Synthetic
aactaggc

SEQ ID NO: 182 - DNA, 8 bp, Artificial sequence
  Synthetic
cagcaagt

SEQ ID NO: 183 - DNA, 8 bp, Artificial sequence
  Synthetic
acgaggta

SEQ ID NO: 184 - DNA, 8 bp, Artificial sequence
  Synthetic
catcttcc

SEQ ID NO: 185 - DNA, 8 bp, Artificial sequence
  Synthetic
cctgaatc

SEQ ID NO: 186 - DNA, 8 bp, Artificial sequence
  Synthetic
tgcagact

SEQ ID NO: 187 - DNA, 8 bp, Artificial sequence
  Synthetic
agatgtgg

SEQ ID NO: 188 - DNA, 8 bp, Artificial sequence
  Synthetic
agttcgac

SEQ ID NO: 189 - DNA, 8 bp, Artificial sequence
  Synthetic
acaacctc

SEQ ID NO: 190 - DNA, 8 bp, Artificial sequence
  Synthetic
catggtag

SEQ ID NO: 191 - DNA, 8 bp, Artificial sequence
  Synthetic
cgtatctc

SEQ ID NO: 192 - DNA, 8 bp, Artificial sequence
  Synthetic
cctagttc

SEQ ID NO: 193 - DNA, 8 bp, Artificial sequence
  Synthetic
caagagtc

SEQ ID NO: 194 - DNA, 8 bp, Artificial sequence
  Synthetic
aagcatcg

SEQ ID NO: 195 - DNA, 8 bp, Artificial sequence
  Synthetic
gcagaaga

SEQ ID NO: 196 - DNA, 8 bp, Artificial sequence
  Synthetic
caatgcca

SEQ ID NO: 197 - DNA, 8 bp, Artificial sequence
  Synthetic
gcatcgaa

SEQ ID NO: 198 - DNA, 8 bp, Artificial sequence
  Synthetic
aacgaagg

SEQ ID NO: 199 - DNA, 8 bp, Artificial sequence
  Synthetic
caacatgg

SEQ ID NO: 200 - DNA, 8 bp, Artificial sequence
  Synthetic
ttcagtgc

SEQ ID NO: 201 - DNA, 8 bp, Artificial sequence
  Synthetic
ctaagtcc

SEQ ID NO: 202 - DNA, 8 bp, Artificial sequence
  Synthetic
ccagacta

SEQ ID NO: 203 - DNA, 8 bp, Artificial sequence
  Synthetic
gttcctac

SEQ ID NO: 204 - DNA, 8 bp, Artificial sequence
  Synthetic
tgacgcaa

SEQ ID NO: 205 - DNA, 8 bp, Artificial sequence
  Synthetic
cgcataag

SEQ ID NO: 206 - DNA, 8 bp, Artificial sequence
  Synthetic
gcaggtaa

SEQ ID NO: 207 - DNA, 8 bp, Artificial sequence
  Synthetic
acacaacg

SEQ ID NO: 208 - DNA, 8 bp, Artificial sequence
  Synthetic
cacaggaa

SEQ ID NO: 209 - DNA, 8 bp, Artificial sequence
  Synthetic
caggaaca

SEQ ID NO: 210 - DNA, 8 bp, Artificial sequence
  Synthetic
gcaatgtc

SEQ ID NO: 211 - DNA, 8 bp, Artificial sequence
  Synthetic
gcacagat

SEQ ID NO: 212 - DNA, 8 bp, Artificial sequence
  Synthetic
acacgaga

SEQ ID NO: 213 - DNA, 8 bp, Artificial sequence
  Synthetic
atccagtg

SEQ ID NO: 214 - DNA, 8 bp, Artificial sequence
  Synthetic
acgtcagt

SEQ ID NO: 215 - DNA, 8 bp, Artificial sequence
  Synthetic
gctagaac

SEQ ID NO: 216 - DNA, 8 bp, Artificial sequence
  Synthetic
ctacgact

SEQ ID NO: 217 - DNA, 8 bp, Artificial sequence
  Synthetic
gtagcagt

SEQ ID NO: 218 - DNA, 8 bp, Artificial sequence
  Synthetic
ctagtggt

SEQ ID NO: 219 - DNA, 8 bp, Artificial sequence
  Synthetic
cagagaag

SEQ ID NO: 220 - DNA, 8 bp, Artificial sequence
  Synthetic
catcagag

SEQ ID NO: 221 - DNA, 8 bp, Artificial sequence
  Synthetic
tcagagtg

SEQ ID NO: 222 - DNA, 8 bp, Artificial sequence
  Synthetic
aacgctca

SEQ ID NO: 223 - DNA, 8 bp, Artificial sequence
  Synthetic
tacaacgg

SEQ ID NO: 224 - DNA, 8 bp, Artificial sequence
  Synthetic
tatcgcac

SEQ ID NO: 225 - DNA, 8 bp, Artificial sequence
  Synthetic
cgaacaca

SEQ ID NO: 226 - DNA, 8 bp, Artificial sequence
  Synthetic
ccatcaac

SEQ ID NO: 227 - DNA, 8 bp, Artificial sequence
  Synthetic
ctcaacct

SEQ ID NO: 228 - DNA, 8 bp, Artificial sequence
  Synthetic
tcgtagag

SEQ ID NO: 229 - DNA, 8 bp, Artificial sequence
  Synthetic
tcacacac

SEQ ID NO: 230 - DNA, 8 bp, Artificial sequence
  Synthetic
taaccgca

SEQ ID NO: 231 - DNA, 8 bp, Artificial sequence
  Synthetic
tacgctgt

SEQ ID NO: 232 - DNA, 8 bp, Artificial sequence
  Synthetic
cagctcaa

SEQ ID NO: 233 - DNA, 8 bp, Artificial sequence
  Synthetic
gaagcaac

SEQ ID NO: 234 - DNA, 8 bp, Artificial sequence
  Synthetic
tcagtgga

SEQ ID NO: 235 - DNA, 8 bp, Artificial sequence
  Synthetic
ttaacgcg

SEQ ID NO: 236 - DNA, 8 bp, Artificial sequence
  Synthetic
caacgaac

SEQ ID NO: 237 - DNA, 8 bp, Artificial sequence
  Synthetic
tcacgaag

SEQ ID NO: 238 - DNA, 8 bp, Artificial sequence
  Synthetic
cgcatgta

SEQ ID NO: 239 - DNA, 8 bp, Artificial sequence
  Synthetic
cggtatca

SEQ ID NO: 240 - DNA, 8 bp, Artificial sequence
  Synthetic
cttcaacg

SEQ ID NO: 241 - DNA, 8 bp, Artificial sequence
  Synthetic
cagaatgc

SEQ ID NO: 242 - DNA, 8 bp, Artificial sequence
  Synthetic
gtcaacga

SEQ ID NO: 243 - DNA, 8 bp, Artificial sequence
  Synthetic
gctacaca

SEQ ID NO: 244 - DNA, 8 bp, Artificial sequence
  Synthetic
gcattggt

SEQ ID NO: 245 - DNA, 8 bp, Artificial sequence
  Synthetic
caagcaga

SEQ ID NO: 246 - DNA, 8 bp, Artificial sequence
  Synthetic
acgcagaa

SEQ ID NO: 247 - DNA, 8 bp, Artificial sequence
  Synthetic
acaacgca

SEQ ID NO: 248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnaatcggcanntttttttttttttttttttttttttttttt

SEQ ID NO: 249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntacggcatnntttttttttttttttttttttttttttttt

SEQ ID NO: 250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnttggatcgnntttttttttttttttttttttttttttttt

SEQ ID NO: 251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntggaacganntttttttttttttttttttttttttttttt

SEQ ID NO: 252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnggcaatcanntttttttttttttttttttttttttttttt

SEQ ID NO: 253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngaatccganntttttttttttttttttttttttttttttt

SEQ ID NO: 254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnttacggtgnntttttttttttttttttttttttttttttt

SEQ ID NO: 255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncatatcggnntttttttttttttttttttttttttttttt

SEQ ID NO: 256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncttcggtanntttttttttttttttttttttttttttttt

SEQ ID NO: 257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntcctaacgnntttttttttttttttttttttttttttttt

SEQ ID NO: 258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngtaagccanntttttttttttttttttttttttttttttt

SEQ ID NO: 259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntaaggtggnntttttttttttttttttttttttttttttt

SEQ ID NO: 260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnggtaagctnntttttttttttttttttttttttttttttt

SEQ ID NO: 261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntgtgtcganntttttttttttttttttttttttttttttt

SEQ ID NO: 262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngagcatganntttttttttttttttttttttttttttttt

SEQ ID NO: 263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntcgaagtcnntttttttttttttttttttttttttttttt

SEQ ID NO: 264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnggtgaacanntttttttttttttttttttttttttttttt

SEQ ID NO: 265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnacatgcacnntttttttttttttttttttttttttttttt

SEQ ID NO: 266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnccaacagtnntttttttttttttttttttttttttttttt

SEQ ID NO: 267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnagaacagcnntttttttttttttttttttttttttttttt

SEQ ID NO: 268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngaacacgtnntttttttttttttttttttttttttttttt

SEQ ID NO: 269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnggtcttcanntttttttttttttttttttttttttttttt

SEQ ID NO: 270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnaggttcagnntttttttttttttttttttttttttttttt

SEQ ID NO: 271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnctagagcanntttttttttttttttttttttttttttttt

SEQ ID NO: 272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncttctagcnntttttttttttttttttttttttttttttt

SEQ ID NO: 273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngagtaacgnntttttttttttttttttttttttttttttt

SEQ ID NO: 274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnctaagaggnntttttttttttttttttttttttttttttt

SEQ ID NO: 275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnacgtgtagnntttttttttttttttttttttttttttttt

SEQ ID NO: 276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnactacaggnntttttttttttttttttttttttttttttt

SEQ ID NO: 277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntacaggtcnntttttttttttttttttttttttttttttt

SEQ ID NO: 278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnctcacatgnntttttttttttttttttttttttttttttt

SEQ ID NO: 279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnactaggagnntttttttttttttttttttttttttttttt

SEQ ID NO: 280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnccatagganntttttttttttttttttttttttttttttt

SEQ ID NO: 281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnggagaatcnntttttttttttttttttttttttttttttt

SEQ ID NO: 282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngccaagaanntttttttttttttttttttttttttttttt

SEQ ID NO: 283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnaaggcaagnntttttttttttttttttttttttttttttt

SEQ ID NO: 284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnaatgtcgcnntttttttttttttttttttttttttttttt

SEQ ID NO: 285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnatggaaccnntttttttttttttttttttttttttttttt

SEQ ID NO: 286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnagaggcatnntttttttttttttttttttttttttttttt

SEQ ID NO: 287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntgcatagcnntttttttttttttttttttttttttttttt

SEQ ID NO: 288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnctaacgganntttttttttttttttttttttttttttttt

SEQ ID NO: 289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntatcgaggnntttttttttttttttttttttttttttttt

SEQ ID NO: 290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncatagcctnntttttttttttttttttttttttttttttt

SEQ ID NO: 291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnatcgagacnntttttttttttttttttttttttttttttt

SEQ ID NO: 292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnggaagagtnntttttttttttttttttttttttttttttt

SEQ ID NO: 293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnccaagtagnntttttttttttttttttttttttttttttt

SEQ ID NO: 294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnctgaacagnntttttttttttttttttttttttttttttt

SEQ ID NO: 295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngtaggttcnntttttttttttttttttttttttttttttt

SEQ ID NO: 296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngtatggacnntttttttttttttttttttttttttttttt

SEQ ID NO: 297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntcgcaacanntttttttttttttttttttttttttttttt

SEQ ID NO: 298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnccgctaatnntttttttttttttttttttttttttttttt

SEQ ID NO: 299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngattcgcanntttttttttttttttttttttttttttttt

SEQ ID NO: 300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncgatggaanntttttttttttttttttttttttttttttt

SEQ ID NO: 301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnagcaagganntttttttttttttttttttttttttttttt

SEQ ID NO: 302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncgtagcaanntttttttttttttttttttttttttttttt

SEQ ID NO: 303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntggcagtanntttttttttttttttttttttttttttttt

SEQ ID NO: 304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncggtagttnntttttttttttttttttttttttttttttt

SEQ ID NO: 305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntgacttcgnntttttttttttttttttttttttttttttt

SEQ ID NO: 306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngagtgcaanntttttttttttttttttttttttttttttt

SEQ ID NO: 307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnacggtaacnntttttttttttttttttttttttttttttt

SEQ ID NO: 308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnaagtggtgnntttttttttttttttttttttttttttttt

SEQ ID NO: 309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnggagacaanntttttttttttttttttttttttttttttt

SEQ ID NO: 310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntcaaggacnntttttttttttttttttttttttttttttt

SEQ ID NO: 311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnaagagagcnntttttttttttttttttttttttttttttt

SEQ ID NO: 312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncgagagatnntttttttttttttttttttttttttttttt

SEQ ID NO: 313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnacagatggnntttttttttttttttttttttttttttttt

SEQ ID NO: 314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnaggagtcanntttttttttttttttttttttttttttttt

SEQ ID NO: 315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncgtgttacnntttttttttttttttttttttttttttttt

SEQ ID NO: 316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntagtgtgcnntttttttttttttttttttttttttttttt

SEQ ID NO: 317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnctcatgacnntttttttttttttttttttttttttttttt

SEQ ID NO: 318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngtatccagnntttttttttttttttttttttttttttttt

SEQ ID NO: 319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnacgcctatnntttttttttttttttttttttttttttttt

SEQ ID NO: 320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnaacgacctnntttttttttttttttttttttttttttttt

SEQ ID NO: 321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnatcaggctnntttttttttttttttttttttttttttttt

SEQ ID NO: 322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncaagttcgnntttttttttttttttttttttttttttttt

SEQ ID NO: 323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntagccaganntttttttttttttttttttttttttttttt

SEQ ID NO: 324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncaatcacgnntttttttttttttttttttttttttttttt

SEQ ID NO: 325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnngcaacaagnntttttttttttttttttttttttttttttt

SEQ ID NO: 326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncacgacaanntttttttttttttttttttttttttttttt

SEQ ID NO: 327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntacggaganntttttttttttttttttttttttttttttt

SEQ ID NO: 328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncgacaaganntttttttttttttttttttttttttttttt

SEQ ID NO: 329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncgaagtganntttttttttttttttttttttttttttttt

SEQ ID NO: 330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnagctggtanntttttttttttttttttttttttttttttt

SEQ ID NO: 331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnaactaggcnntttttttttttttttttttttttttttttt

SEQ ID NO: 332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncagcaagtnntttttttttttttttttttttttttttttt

SEQ ID NO: 333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnacgaggtanntttttttttttttttttttttttttttttt

SEQ ID NO: 334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncatcttccnntttttttttttttttttttttttttttttt

SEQ ID NO: 335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncctgaatcnntttttttttttttttttttttttttttttt

SEQ ID NO: 336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnntgcagactnntttttttttttttttttttttttttttttt

SEQ ID NO: 337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnagatgtggnntttttttttttttttttttttttttttttt

SEQ ID NO: 338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnagttcgacnntttttttttttttttttttttttttttttt

SEQ ID NO: 339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnnacaacctcnntttttttttttttttttttttttttttttt

SEQ ID NO: 340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncatggtagnntttttttttttttttttttttttttttttt

SEQ ID NO: 341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncgtatctcnntttttttttttttttttttttttttttttt

SEQ ID NO: 342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncctagttcnntttttttttttttttttttttttttttttt

SEQ ID NO: 343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngattggagnncaagagtcnntttttttttttttttttttttttttttttt

SEQ ID NO: 344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnaatcggcanntttttttttttttttttttttttttttttt

SEQ ID NO: 345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntacggcatnntttttttttttttttttttttttttttttt

SEQ ID NO: 346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnttggatcgnntttttttttttttttttttttttttttttt

SEQ ID NO: 347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntggaacganntttttttttttttttttttttttttttttt

SEQ ID NO: 348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnggcaatcanntttttttttttttttttttttttttttttt

SEQ ID NO: 349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngaatccganntttttttttttttttttttttttttttttt

SEQ ID NO: 350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnttacggtgnntttttttttttttttttttttttttttttt

SEQ ID NO: 351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncatatcggnntttttttttttttttttttttttttttttt

SEQ ID NO: 352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncttcggtanntttttttttttttttttttttttttttttt

SEQ ID NO: 353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntcctaacgnntttttttttttttttttttttttttttttt

SEQ ID NO: 354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngtaagccanntttttttttttttttttttttttttttttt

SEQ ID NO: 355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntaaggtggnntttttttttttttttttttttttttttttt

SEQ ID NO: 356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnggtaagctnntttttttttttttttttttttttttttttt

SEQ ID NO: 357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntgtgtcganntttttttttttttttttttttttttttttt

SEQ ID NO: 358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngagcatganntttttttttttttttttttttttttttttt

SEQ ID NO: 359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntcgaagtcnntttttttttttttttttttttttttttttt

SEQ ID NO: 360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnggtgaacanntttttttttttttttttttttttttttttt

SEQ ID NO: 361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnacatgcacnntttttttttttttttttttttttttttttt

SEQ ID NO: 362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnccaacagtnntttttttttttttttttttttttttttttt

SEQ ID NO: 363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnagaacagcnntttttttttttttttttttttttttttttt

SEQ ID NO: 364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngaacacgtnntttttttttttttttttttttttttttttt

SEQ ID NO: 365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnggtcttcanntttttttttttttttttttttttttttttt

SEQ ID NO: 366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnaggttcagnntttttttttttttttttttttttttttttt

SEQ ID NO: 367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnctagagcanntttttttttttttttttttttttttttttt

SEQ ID NO: 368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncttctagcnntttttttttttttttttttttttttttttt

SEQ ID NO: 369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngagtaacgnntttttttttttttttttttttttttttttt

SEQ ID NO: 370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnctaagaggnntttttttttttttttttttttttttttttt

SEQ ID NO: 371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnacgtgtagnntttttttttttttttttttttttttttttt

SEQ ID NO: 372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnactacaggnntttttttttttttttttttttttttttttt

SEQ ID NO: 373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntacaggtcnntttttttttttttttttttttttttttttt

SEQ ID NO: 374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnctcacatgnntttttttttttttttttttttttttttttt

SEQ ID NO: 375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnactaggagnntttttttttttttttttttttttttttttt

SEQ ID NO: 376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnccatagganntttttttttttttttttttttttttttttt

SEQ ID NO: 377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnggagaatcnntttttttttttttttttttttttttttttt

SEQ ID NO: 378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngccaagaanntttttttttttttttttttttttttttttt

SEQ ID NO: 379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnaaggcaagnntttttttttttttttttttttttttttttt

SEQ ID NO: 380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnaatgtcgcnntttttttttttttttttttttttttttttt

SEQ ID NO: 381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnatggaaccnntttttttttttttttttttttttttttttt

SEQ ID NO: 382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnagaggcatnntttttttttttttttttttttttttttttt

SEQ ID NO: 383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntgcatagcnntttttttttttttttttttttttttttttt

SEQ ID NO: 384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnctaacgganntttttttttttttttttttttttttttttt

SEQ ID NO: 385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntatcgaggnntttttttttttttttttttttttttttttt

SEQ ID NO: 386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncatagcctnntttttttttttttttttttttttttttttt

SEQ ID NO: 387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnatcgagacnntttttttttttttttttttttttttttttt

SEQ ID NO: 388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnggaagagtnntttttttttttttttttttttttttttttt

SEQ ID NO: 389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnccaagtagnntttttttttttttttttttttttttttttt

SEQ ID NO: 390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnctgaacagnntttttttttttttttttttttttttttttt

SEQ ID NO: 391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngtaggttcnntttttttttttttttttttttttttttttt

SEQ ID NO: 392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngtatggacnntttttttttttttttttttttttttttttt

SEQ ID NO: 393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntcgcaacanntttttttttttttttttttttttttttttt

SEQ ID NO: 394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnccgctaatnntttttttttttttttttttttttttttttt

SEQ ID NO: 395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngattcgcanntttttttttttttttttttttttttttttt

SEQ ID NO: 396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncgatggaanntttttttttttttttttttttttttttttt

SEQ ID NO: 397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnagcaagganntttttttttttttttttttttttttttttt

SEQ ID NO: 398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncgtagcaanntttttttttttttttttttttttttttttt

SEQ ID NO: 399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntggcagtanntttttttttttttttttttttttttttttt

SEQ ID NO: 400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncggtagttnntttttttttttttttttttttttttttttt

SEQ ID NO: 401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntgacttcgnntttttttttttttttttttttttttttttt

SEQ ID NO: 402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngagtgcaanntttttttttttttttttttttttttttttt

SEQ ID NO: 403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnacggtaacnntttttttttttttttttttttttttttttt

SEQ ID NO: 404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnaagtggtgnntttttttttttttttttttttttttttttt

SEQ ID NO: 405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnggagacaanntttttttttttttttttttttttttttttt

SEQ ID NO: 406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntcaaggacnntttttttttttttttttttttttttttttt

SEQ ID NO: 407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnaagagagcnntttttttttttttttttttttttttttttt

SEQ ID NO: 408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncgagagatnntttttttttttttttttttttttttttttt

SEQ ID NO: 409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnacagatggnntttttttttttttttttttttttttttttt

SEQ ID NO: 410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnaggagtcanntttttttttttttttttttttttttttttt

SEQ ID NO: 411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncgtgttacnntttttttttttttttttttttttttttttt

SEQ ID NO: 412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntagtgtgcnntttttttttttttttttttttttttttttt

SEQ ID NO: 413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnctcatgacnntttttttttttttttttttttttttttttt

SEQ ID NO: 414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngtatccagnntttttttttttttttttttttttttttttt

SEQ ID NO: 415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnacgcctatnntttttttttttttttttttttttttttttt

SEQ ID NO: 416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnaacgacctnntttttttttttttttttttttttttttttt

SEQ ID NO: 417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnatcaggctnntttttttttttttttttttttttttttttt

SEQ ID NO: 418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncaagttcgnntttttttttttttttttttttttttttttt

SEQ ID NO: 419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntagccaganntttttttttttttttttttttttttttttt

SEQ ID NO: 420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncaatcacgnntttttttttttttttttttttttttttttt

SEQ ID NO: 421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnngcaacaagnntttttttttttttttttttttttttttttt

SEQ ID NO: 422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncacgacaanntttttttttttttttttttttttttttttt

SEQ ID NO: 423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntacggaganntttttttttttttttttttttttttttttt

SEQ ID NO: 424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncgacaaganntttttttttttttttttttttttttttttt

SEQ ID NO: 425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncgaagtganntttttttttttttttttttttttttttttt

SEQ ID NO: 426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnagctggtanntttttttttttttttttttttttttttttt

SEQ ID NO: 427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnaactaggcnntttttttttttttttttttttttttttttt

SEQ ID NO: 428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncagcaagtnntttttttttttttttttttttttttttttt

SEQ ID NO: 429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnacgaggtanntttttttttttttttttttttttttttttt

SEQ ID NO: 430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncatcttccnntttttttttttttttttttttttttttttt

SEQ ID NO: 431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncctgaatcnntttttttttttttttttttttttttttttt

SEQ ID NO: 432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnntgcagactnntttttttttttttttttttttttttttttt

SEQ ID NO: 433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnagatgtggnntttttttttttttttttttttttttttttt

SEQ ID NO: 434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnagttcgacnntttttttttttttttttttttttttttttt

SEQ ID NO: 435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnnacaacctcnntttttttttttttttttttttttttttttt

SEQ ID NO: 436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncatggtagnntttttttttttttttttttttttttttttt

SEQ ID NO: 437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncgtatctcnntttttttttttttttttttttttttttttt

SEQ ID NO: 438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncctagttcnntttttttttttttttttttttttttttttt

SEQ ID NO: 439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggatgaagnncaagagtcnntttttttttttttttttttttttttttttt

SEQ ID NO: 440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnaatcggcanntttttttttttttttttttttttttttttt

SEQ ID NO: 441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntacggcatnntttttttttttttttttttttttttttttt

SEQ ID NO: 442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnttggatcgnntttttttttttttttttttttttttttttt

SEQ ID NO: 443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntggaacganntttttttttttttttttttttttttttttt

SEQ ID NO: 444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnggcaatcanntttttttttttttttttttttttttttttt

SEQ ID NO: 445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngaatccganntttttttttttttttttttttttttttttt

SEQ ID NO: 446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnttacggtgnntttttttttttttttttttttttttttttt

SEQ ID NO: 447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncatatcggnntttttttttttttttttttttttttttttt

SEQ ID NO: 448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncttcggtanntttttttttttttttttttttttttttttt

SEQ ID NO: 449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntcctaacgnntttttttttttttttttttttttttttttt

SEQ ID NO: 450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngtaagccanntttttttttttttttttttttttttttttt

SEQ ID NO: 451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntaaggtggnntttttttttttttttttttttttttttttt

SEQ ID NO: 452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnggtaagctnntttttttttttttttttttttttttttttt

SEQ ID NO: 453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntgtgtcganntttttttttttttttttttttttttttttt

SEQ ID NO: 454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngagcatganntttttttttttttttttttttttttttttt

SEQ ID NO: 455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntcgaagtcnntttttttttttttttttttttttttttttt

SEQ ID NO: 456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnggtgaacanntttttttttttttttttttttttttttttt

SEQ ID NO: 457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnacatgcacnntttttttttttttttttttttttttttttt

SEQ ID NO: 458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnccaacagtnntttttttttttttttttttttttttttttt

SEQ ID NO: 459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnagaacagcnntttttttttttttttttttttttttttttt

SEQ ID NO: 460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngaacacgtnntttttttttttttttttttttttttttttt

SEQ ID NO: 461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnggtcttcanntttttttttttttttttttttttttttttt

SEQ ID NO: 462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnaggttcagnntttttttttttttttttttttttttttttt

SEQ ID NO: 463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnctagagcanntttttttttttttttttttttttttttttt

SEQ ID NO: 464 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncttctagcnntttttttttttttttttttttttttttttt

SEQ ID NO: 465 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngagtaacgnntttttttttttttttttttttttttttttt

SEQ ID NO: 466 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnctaagaggnntttttttttttttttttttttttttttttt

SEQ ID NO: 467 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnacgtgtagnntttttttttttttttttttttttttttttt

SEQ ID NO: 468 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnactacaggnntttttttttttttttttttttttttttttt

SEQ ID NO: 469 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntacaggtcnntttttttttttttttttttttttttttttt

SEQ ID NO: 470 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnctcacatgnntttttttttttttttttttttttttttttt

SEQ ID NO: 471 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnactaggagnntttttttttttttttttttttttttttttt

SEQ ID NO: 472 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnccatagganntttttttttttttttttttttttttttttt

SEQ ID NO: 473 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnggagaatcnntttttttttttttttttttttttttttttt

SEQ ID NO: 474 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngccaagaanntttttttttttttttttttttttttttttt

SEQ ID NO: 475 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnaaggcaagnntttttttttttttttttttttttttttttt

SEQ ID NO: 476 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnaatgtcgcnntttttttttttttttttttttttttttttt

SEQ ID NO: 477 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnatggaaccnntttttttttttttttttttttttttttttt

SEQ ID NO: 478 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnagaggcatnntttttttttttttttttttttttttttttt

SEQ ID NO: 479 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntgcatagcnntttttttttttttttttttttttttttttt

SEQ ID NO: 480 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnctaacgganntttttttttttttttttttttttttttttt

SEQ ID NO: 481 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntatcgaggnntttttttttttttttttttttttttttttt

SEQ ID NO: 482 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncatagcctnntttttttttttttttttttttttttttttt

SEQ ID NO: 483 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnatcgagacnntttttttttttttttttttttttttttttt

SEQ ID NO: 484 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnggaagagtnntttttttttttttttttttttttttttttt

SEQ ID NO: 485 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnccaagtagnntttttttttttttttttttttttttttttt

SEQ ID NO: 486 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnctgaacagnntttttttttttttttttttttttttttttt

SEQ ID NO: 487 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngtaggttcnntttttttttttttttttttttttttttttt

SEQ ID NO: 488 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngtatggacnntttttttttttttttttttttttttttttt

SEQ ID NO: 489 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntcgcaacanntttttttttttttttttttttttttttttt

SEQ ID NO: 490 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnccgctaatnntttttttttttttttttttttttttttttt

SEQ ID NO: 491 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngattcgcanntttttttttttttttttttttttttttttt

SEQ ID NO: 492 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncgatggaanntttttttttttttttttttttttttttttt

SEQ ID NO: 493 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnagcaagganntttttttttttttttttttttttttttttt

SEQ ID NO: 494 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncgtagcaanntttttttttttttttttttttttttttttt

SEQ ID NO: 495 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntggcagtanntttttttttttttttttttttttttttttt

SEQ ID NO: 496 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncggtagttnntttttttttttttttttttttttttttttt

SEQ ID NO: 497 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntgacttcgnntttttttttttttttttttttttttttttt

SEQ ID NO: 498 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngagtgcaanntttttttttttttttttttttttttttttt

SEQ ID NO: 499 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnacggtaacnntttttttttttttttttttttttttttttt

SEQ ID NO: 500 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnaagtggtgnntttttttttttttttttttttttttttttt

SEQ ID NO: 501 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnggagacaanntttttttttttttttttttttttttttttt

SEQ ID NO: 502 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntcaaggacnntttttttttttttttttttttttttttttt

SEQ ID NO: 503 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnaagagagcnntttttttttttttttttttttttttttttt

SEQ ID NO: 504 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncgagagatnntttttttttttttttttttttttttttttt

SEQ ID NO: 505 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnacagatggnntttttttttttttttttttttttttttttt

SEQ ID NO: 506 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnaggagtcanntttttttttttttttttttttttttttttt

SEQ ID NO: 507 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncgtgttacnntttttttttttttttttttttttttttttt

SEQ ID NO: 508 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntagtgtgcnntttttttttttttttttttttttttttttt

SEQ ID NO: 509 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnctcatgacnntttttttttttttttttttttttttttttt

SEQ ID NO: 510 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngtatccagnntttttttttttttttttttttttttttttt

SEQ ID NO: 511 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnacgcctatnntttttttttttttttttttttttttttttt

SEQ ID NO: 512 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnaacgacctnntttttttttttttttttttttttttttttt

SEQ ID NO: 513 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnatcaggctnntttttttttttttttttttttttttttttt

SEQ ID NO: 514 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncaagttcgnntttttttttttttttttttttttttttttt

SEQ ID NO: 515 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntagccaganntttttttttttttttttttttttttttttt

SEQ ID NO: 516 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncaatcacgnntttttttttttttttttttttttttttttt

SEQ ID NO: 517 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnngcaacaagnntttttttttttttttttttttttttttttt

SEQ ID NO: 518 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncacgacaanntttttttttttttttttttttttttttttt

SEQ ID NO: 519 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntacggaganntttttttttttttttttttttttttttttt

SEQ ID NO: 520 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncgacaaganntttttttttttttttttttttttttttttt

SEQ ID NO: 521 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncgaagtganntttttttttttttttttttttttttttttt

SEQ ID NO: 522 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnagctggtanntttttttttttttttttttttttttttttt

SEQ ID NO: 523 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnaactaggcnntttttttttttttttttttttttttttttt

SEQ ID NO: 524 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncagcaagtnntttttttttttttttttttttttttttttt

SEQ ID NO: 525 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnacgaggtanntttttttttttttttttttttttttttttt

SEQ ID NO: 526 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncatcttccnntttttttttttttttttttttttttttttt

SEQ ID NO: 527 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncctgaatcnntttttttttttttttttttttttttttttt

SEQ ID NO: 528 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnntgcagactnntttttttttttttttttttttttttttttt

SEQ ID NO: 529 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnagatgtggnntttttttttttttttttttttttttttttt

SEQ ID NO: 530 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnagttcgacnntttttttttttttttttttttttttttttt

SEQ ID NO: 531 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnnacaacctcnntttttttttttttttttttttttttttttt

SEQ ID NO: 532 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncatggtagnntttttttttttttttttttttttttttttt

SEQ ID NO: 533 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncgtatctcnntttttttttttttttttttttttttttttt

SEQ ID NO: 534 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncctagttcnntttttttttttttttttttttttttttttt

SEQ ID NO: 535 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggaggatnncaagagtcnntttttttttttttttttttttttttttttt

SEQ ID NO: 536 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnaatcggcanntttttttttttttttttttttttttttttt

SEQ ID NO: 537 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntacggcatnntttttttttttttttttttttttttttttt

SEQ ID NO: 538 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnttggatcgnntttttttttttttttttttttttttttttt

SEQ ID NO: 539 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntggaacganntttttttttttttttttttttttttttttt

SEQ ID NO: 540 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnggcaatcanntttttttttttttttttttttttttttttt

SEQ ID NO: 541 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngaatccganntttttttttttttttttttttttttttttt

SEQ ID NO: 542 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnttacggtgnntttttttttttttttttttttttttttttt

SEQ ID NO: 543 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncatatcggnntttttttttttttttttttttttttttttt

SEQ ID NO: 544 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncttcggtanntttttttttttttttttttttttttttttt

SEQ ID NO: 545 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntcctaacgnntttttttttttttttttttttttttttttt

SEQ ID NO: 546 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngtaagccanntttttttttttttttttttttttttttttt

SEQ ID NO: 547 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntaaggtggnntttttttttttttttttttttttttttttt

SEQ ID NO: 548 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnggtaagctnntttttttttttttttttttttttttttttt

SEQ ID NO: 549 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntgtgtcganntttttttttttttttttttttttttttttt

SEQ ID NO: 550 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngagcatganntttttttttttttttttttttttttttttt

SEQ ID NO: 551 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntcgaagtcnntttttttttttttttttttttttttttttt

SEQ ID NO: 552 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnggtgaacanntttttttttttttttttttttttttttttt

SEQ ID NO: 553 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnacatgcacnntttttttttttttttttttttttttttttt

SEQ ID NO: 554 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnccaacagtnntttttttttttttttttttttttttttttt

SEQ ID NO: 555 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnagaacagcnntttttttttttttttttttttttttttttt

SEQ ID NO: 556 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngaacacgtnntttttttttttttttttttttttttttttt

SEQ ID NO: 557 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnggtcttcanntttttttttttttttttttttttttttttt

SEQ ID NO: 558 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnaggttcagnntttttttttttttttttttttttttttttt

SEQ ID NO: 559 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnctagagcanntttttttttttttttttttttttttttttt

SEQ ID NO: 560 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncttctagcnntttttttttttttttttttttttttttttt

SEQ ID NO: 561 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngagtaacgnntttttttttttttttttttttttttttttt

SEQ ID NO: 562 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnctaagaggnntttttttttttttttttttttttttttttt

SEQ ID NO: 563 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnacgtgtagnntttttttttttttttttttttttttttttt

SEQ ID NO: 564 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnactacaggnntttttttttttttttttttttttttttttt

SEQ ID NO: 565 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntacaggtcnntttttttttttttttttttttttttttttt

SEQ ID NO: 566 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnctcacatgnntttttttttttttttttttttttttttttt

SEQ ID NO: 567 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnactaggagnntttttttttttttttttttttttttttttt

SEQ ID NO: 568 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnccatagganntttttttttttttttttttttttttttttt

SEQ ID NO: 569 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnggagaatcnntttttttttttttttttttttttttttttt

SEQ ID NO: 570 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngccaagaanntttttttttttttttttttttttttttttt

SEQ ID NO: 571 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnaaggcaagnntttttttttttttttttttttttttttttt

SEQ ID NO: 572 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnaatgtcgcnntttttttttttttttttttttttttttttt

SEQ ID NO: 573 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnatggaaccnntttttttttttttttttttttttttttttt

SEQ ID NO: 574 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnagaggcatnntttttttttttttttttttttttttttttt

SEQ ID NO: 575 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntgcatagcnntttttttttttttttttttttttttttttt

SEQ ID NO: 576 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnctaacgganntttttttttttttttttttttttttttttt

SEQ ID NO: 577 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntatcgaggnntttttttttttttttttttttttttttttt

SEQ ID NO: 578 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncatagcctnntttttttttttttttttttttttttttttt

SEQ ID NO: 579 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnatcgagacnntttttttttttttttttttttttttttttt

SEQ ID NO: 580 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnggaagagtnntttttttttttttttttttttttttttttt

SEQ ID NO: 581 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnccaagtagnntttttttttttttttttttttttttttttt

SEQ ID NO: 582 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnctgaacagnntttttttttttttttttttttttttttttt

SEQ ID NO: 583 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngtaggttcnntttttttttttttttttttttttttttttt

SEQ ID NO: 584 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngtatggacnntttttttttttttttttttttttttttttt

SEQ ID NO: 585 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntcgcaacanntttttttttttttttttttttttttttttt

SEQ ID NO: 586 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnccgctaatnntttttttttttttttttttttttttttttt

SEQ ID NO: 587 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngattcgcanntttttttttttttttttttttttttttttt

SEQ ID NO: 588 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncgatggaanntttttttttttttttttttttttttttttt

SEQ ID NO: 589 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnagcaagganntttttttttttttttttttttttttttttt

SEQ ID NO: 590 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncgtagcaanntttttttttttttttttttttttttttttt

SEQ ID NO: 591 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntggcagtanntttttttttttttttttttttttttttttt

SEQ ID NO: 592 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncggtagttnntttttttttttttttttttttttttttttt

SEQ ID NO: 593 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntgacttcgnntttttttttttttttttttttttttttttt

SEQ ID NO: 594 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngagtgcaanntttttttttttttttttttttttttttttt

SEQ ID NO: 595 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnacggtaacnntttttttttttttttttttttttttttttt

SEQ ID NO: 596 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnaagtggtgnntttttttttttttttttttttttttttttt

SEQ ID NO: 597 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnggagacaanntttttttttttttttttttttttttttttt

SEQ ID NO: 598 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntcaaggacnntttttttttttttttttttttttttttttt

SEQ ID NO: 599 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnaagagagcnntttttttttttttttttttttttttttttt

SEQ ID NO: 600 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncgagagatnntttttttttttttttttttttttttttttt

SEQ ID NO: 601 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnacagatggnntttttttttttttttttttttttttttttt

SEQ ID NO: 602 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnaggagtcanntttttttttttttttttttttttttttttt

SEQ ID NO: 603 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncgtgttacnntttttttttttttttttttttttttttttt

SEQ ID NO: 604 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntagtgtgcnntttttttttttttttttttttttttttttt

SEQ ID NO: 605 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnctcatgacnntttttttttttttttttttttttttttttt

SEQ ID NO: 606 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngtatccagnntttttttttttttttttttttttttttttt

SEQ ID NO: 607 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnacgcctatnntttttttttttttttttttttttttttttt

SEQ ID NO: 608 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnaacgacctnntttttttttttttttttttttttttttttt

SEQ ID NO: 609 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnatcaggctnntttttttttttttttttttttttttttttt

SEQ ID NO: 610 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncaagttcgnntttttttttttttttttttttttttttttt

SEQ ID NO: 611 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntagccaganntttttttttttttttttttttttttttttt

SEQ ID NO: 612 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncaatcacgnntttttttttttttttttttttttttttttt

SEQ ID NO: 613 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnngcaacaagnntttttttttttttttttttttttttttttt

SEQ ID NO: 614 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncacgacaanntttttttttttttttttttttttttttttt

SEQ ID NO: 615 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntacggaganntttttttttttttttttttttttttttttt

SEQ ID NO: 616 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncgacaaganntttttttttttttttttttttttttttttt

SEQ ID NO: 617 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncgaagtganntttttttttttttttttttttttttttttt

SEQ ID NO: 618 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnagctggtanntttttttttttttttttttttttttttttt

SEQ ID NO: 619 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnaactaggcnntttttttttttttttttttttttttttttt

SEQ ID NO: 620 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncagcaagtnntttttttttttttttttttttttttttttt

SEQ ID NO: 621 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnacgaggtanntttttttttttttttttttttttttttttt

SEQ ID NO: 622 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncatcttccnntttttttttttttttttttttttttttttt

SEQ ID NO: 623 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncctgaatcnntttttttttttttttttttttttttttttt

SEQ ID NO: 624 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnntgcagactnntttttttttttttttttttttttttttttt

SEQ ID NO: 625 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnagatgtggnntttttttttttttttttttttttttttttt

SEQ ID NO: 626 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnagttcgacnntttttttttttttttttttttttttttttt

SEQ ID NO: 627 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnnacaacctcnntttttttttttttttttttttttttttttt

SEQ ID NO: 628 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncatggtagnntttttttttttttttttttttttttttttt

SEQ ID NO: 629 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncgtatctcnntttttttttttttttttttttttttttttt

SEQ ID NO: 630 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncctagttcnntttttttttttttttttttttttttttttt

SEQ ID NO: 631 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggtaaggnncaagagtcnntttttttttttttttttttttttttttttt

SEQ ID NO: 632 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnaatcggcanntttttttttttttttttttttttttttttt

SEQ ID NO: 633 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntacggcatnntttttttttttttttttttttttttttttt

SEQ ID NO: 634 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnttggatcgnntttttttttttttttttttttttttttttt

SEQ ID NO: 635 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntggaacganntttttttttttttttttttttttttttttt

SEQ ID NO: 636 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnggcaatcanntttttttttttttttttttttttttttttt

SEQ ID NO: 637 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngaatccganntttttttttttttttttttttttttttttt

SEQ ID NO: 638 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnttacggtgnntttttttttttttttttttttttttttttt

SEQ ID NO: 639 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncatatcggnntttttttttttttttttttttttttttttt

SEQ ID NO: 640 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncttcggtanntttttttttttttttttttttttttttttt

SEQ ID NO: 641 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntcctaacgnntttttttttttttttttttttttttttttt

SEQ ID NO: 642 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngtaagccanntttttttttttttttttttttttttttttt

SEQ ID NO: 643 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntaaggtggnntttttttttttttttttttttttttttttt

SEQ ID NO: 644 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnggtaagctnntttttttttttttttttttttttttttttt

SEQ ID NO: 645 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntgtgtcganntttttttttttttttttttttttttttttt

SEQ ID NO: 646 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngagcatganntttttttttttttttttttttttttttttt

SEQ ID NO: 647 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntcgaagtcnntttttttttttttttttttttttttttttt

SEQ ID NO: 648 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnggtgaacanntttttttttttttttttttttttttttttt

SEQ ID NO: 649 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnacatgcacnntttttttttttttttttttttttttttttt

SEQ ID NO: 650 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnccaacagtnntttttttttttttttttttttttttttttt

SEQ ID NO: 651 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnagaacagcnntttttttttttttttttttttttttttttt

SEQ ID NO: 652 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngaacacgtnntttttttttttttttttttttttttttttt

SEQ ID NO: 653 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnggtcttcanntttttttttttttttttttttttttttttt

SEQ ID NO: 654 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnaggttcagnntttttttttttttttttttttttttttttt

SEQ ID NO: 655 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnctagagcanntttttttttttttttttttttttttttttt

SEQ ID NO: 656 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncttctagcnntttttttttttttttttttttttttttttt

SEQ ID NO: 657 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngagtaacgnntttttttttttttttttttttttttttttt

SEQ ID NO: 658 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnctaagaggnntttttttttttttttttttttttttttttt

SEQ ID NO: 659 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnacgtgtagnntttttttttttttttttttttttttttttt

SEQ ID NO: 660 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnactacaggnntttttttttttttttttttttttttttttt

SEQ ID NO: 661 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntacaggtcnntttttttttttttttttttttttttttttt

SEQ ID NO: 662 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnctcacatgnntttttttttttttttttttttttttttttt

SEQ ID NO: 663 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnactaggagnntttttttttttttttttttttttttttttt

SEQ ID NO: 664 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnccatagganntttttttttttttttttttttttttttttt

SEQ ID NO: 665 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnggagaatcnntttttttttttttttttttttttttttttt

SEQ ID NO: 666 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngccaagaanntttttttttttttttttttttttttttttt

SEQ ID NO: 667 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnaaggcaagnntttttttttttttttttttttttttttttt

SEQ ID NO: 668 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnaatgtcgcnntttttttttttttttttttttttttttttt

SEQ ID NO: 669 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnatggaaccnntttttttttttttttttttttttttttttt

SEQ ID NO: 670 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnagaggcatnntttttttttttttttttttttttttttttt

SEQ ID NO: 671 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntgcatagcnntttttttttttttttttttttttttttttt

SEQ ID NO: 672 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnctaacgganntttttttttttttttttttttttttttttt

SEQ ID NO: 673 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntatcgaggnntttttttttttttttttttttttttttttt

SEQ ID NO: 674 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncatagcctnntttttttttttttttttttttttttttttt

SEQ ID NO: 675 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnatcgagacnntttttttttttttttttttttttttttttt

SEQ ID NO: 676 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnggaagagtnntttttttttttttttttttttttttttttt

SEQ ID NO: 677 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnccaagtagnntttttttttttttttttttttttttttttt

SEQ ID NO: 678 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnctgaacagnntttttttttttttttttttttttttttttt

SEQ ID NO: 679 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngtaggttcnntttttttttttttttttttttttttttttt

SEQ ID NO: 680 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngtatggacnntttttttttttttttttttttttttttttt

SEQ ID NO: 681 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntcgcaacanntttttttttttttttttttttttttttttt

SEQ ID NO: 682 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnccgctaatnntttttttttttttttttttttttttttttt

SEQ ID NO: 683 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngattcgcanntttttttttttttttttttttttttttttt

SEQ ID NO: 684 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncgatggaanntttttttttttttttttttttttttttttt

SEQ ID NO: 685 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnagcaagganntttttttttttttttttttttttttttttt

SEQ ID NO: 686 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncgtagcaanntttttttttttttttttttttttttttttt

SEQ ID NO: 687 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntggcagtanntttttttttttttttttttttttttttttt

SEQ ID NO: 688 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncggtagttnntttttttttttttttttttttttttttttt

SEQ ID NO: 689 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntgacttcgnntttttttttttttttttttttttttttttt

SEQ ID NO: 690 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngagtgcaanntttttttttttttttttttttttttttttt

SEQ ID NO: 691 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnacggtaacnntttttttttttttttttttttttttttttt

SEQ ID NO: 692 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnaagtggtgnntttttttttttttttttttttttttttttt

SEQ ID NO: 693 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnggagacaanntttttttttttttttttttttttttttttt

SEQ ID NO: 694 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntcaaggacnntttttttttttttttttttttttttttttt

SEQ ID NO: 695 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnaagagagcnntttttttttttttttttttttttttttttt

SEQ ID NO: 696 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncgagagatnntttttttttttttttttttttttttttttt

SEQ ID NO: 697 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnacagatggnntttttttttttttttttttttttttttttt

SEQ ID NO: 698 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnaggagtcanntttttttttttttttttttttttttttttt

SEQ ID NO: 699 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncgtgttacnntttttttttttttttttttttttttttttt

SEQ ID NO: 700 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntagtgtgcnntttttttttttttttttttttttttttttt

SEQ ID NO: 701 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnctcatgacnntttttttttttttttttttttttttttttt

SEQ ID NO: 702 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngtatccagnntttttttttttttttttttttttttttttt

SEQ ID NO: 703 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnacgcctatnntttttttttttttttttttttttttttttt

SEQ ID NO: 704 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnaacgacctnntttttttttttttttttttttttttttttt

SEQ ID NO: 705 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnatcaggctnntttttttttttttttttttttttttttttt

SEQ ID NO: 706 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncaagttcgnntttttttttttttttttttttttttttttt

SEQ ID NO: 707 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntagccaganntttttttttttttttttttttttttttttt

SEQ ID NO: 708 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncaatcacgnntttttttttttttttttttttttttttttt

SEQ ID NO: 709 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnngcaacaagnntttttttttttttttttttttttttttttt

SEQ ID NO: 710 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncacgacaanntttttttttttttttttttttttttttttt

SEQ ID NO: 711 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntacggaganntttttttttttttttttttttttttttttt

SEQ ID NO: 712 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncgacaaganntttttttttttttttttttttttttttttt

SEQ ID NO: 713 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncgaagtganntttttttttttttttttttttttttttttt

SEQ ID NO: 714 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnagctggtanntttttttttttttttttttttttttttttt

SEQ ID NO: 715 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnaactaggcnntttttttttttttttttttttttttttttt

SEQ ID NO: 716 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncagcaagtnntttttttttttttttttttttttttttttt

SEQ ID NO: 717 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnacgaggtanntttttttttttttttttttttttttttttt

SEQ ID NO: 718 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncatcttccnntttttttttttttttttttttttttttttt

SEQ ID NO: 719 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncctgaatcnntttttttttttttttttttttttttttttt

SEQ ID NO: 720 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnntgcagactnntttttttttttttttttttttttttttttt

SEQ ID NO: 721 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnagatgtggnntttttttttttttttttttttttttttttt

SEQ ID NO: 722 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnagttcgacnntttttttttttttttttttttttttttttt

SEQ ID NO: 723 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnnacaacctcnntttttttttttttttttttttttttttttt

SEQ ID NO: 724 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncatggtagnntttttttttttttttttttttttttttttt

SEQ ID NO: 725 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncgtatctcnntttttttttttttttttttttttttttttt

SEQ ID NO: 726 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncctagttcnntttttttttttttttttttttttttttttt

SEQ ID NO: 727 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaacttgnncaagagtcnntttttttttttttttttttttttttttttt

SEQ ID NO: 728 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnaatcggcanntttttttttttttttttttttttttttttt

SEQ ID NO: 729 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntacggcatnntttttttttttttttttttttttttttttt

SEQ ID NO: 730 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnttggatcgnntttttttttttttttttttttttttttttt

SEQ ID NO: 731 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntggaacganntttttttttttttttttttttttttttttt

SEQ ID NO: 732 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnggcaatcanntttttttttttttttttttttttttttttt

SEQ ID NO: 733 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngaatccganntttttttttttttttttttttttttttttt

SEQ ID NO: 734 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnttacggtgnntttttttttttttttttttttttttttttt

SEQ ID NO: 735 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncatatcggnntttttttttttttttttttttttttttttt

SEQ ID NO: 736 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncttcggtanntttttttttttttttttttttttttttttt

SEQ ID NO: 737 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntcctaacgnntttttttttttttttttttttttttttttt

SEQ ID NO: 738 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngtaagccanntttttttttttttttttttttttttttttt

SEQ ID NO: 739 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntaaggtggnntttttttttttttttttttttttttttttt

SEQ ID NO: 740 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnggtaagctnntttttttttttttttttttttttttttttt

SEQ ID NO: 741 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntgtgtcganntttttttttttttttttttttttttttttt

SEQ ID NO: 742 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngagcatganntttttttttttttttttttttttttttttt

SEQ ID NO: 743 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntcgaagtcnntttttttttttttttttttttttttttttt

SEQ ID NO: 744 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnggtgaacanntttttttttttttttttttttttttttttt

SEQ ID NO: 745 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnacatgcacnntttttttttttttttttttttttttttttt

SEQ ID NO: 746 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnccaacagtnntttttttttttttttttttttttttttttt

SEQ ID NO: 747 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnagaacagcnntttttttttttttttttttttttttttttt

SEQ ID NO: 748 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngaacacgtnntttttttttttttttttttttttttttttt

SEQ ID NO: 749 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnggtcttcanntttttttttttttttttttttttttttttt

SEQ ID NO: 750 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnaggttcagnntttttttttttttttttttttttttttttt

SEQ ID NO: 751 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnctagagcanntttttttttttttttttttttttttttttt

SEQ ID NO: 752 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncttctagcnntttttttttttttttttttttttttttttt

SEQ ID NO: 753 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngagtaacgnntttttttttttttttttttttttttttttt

SEQ ID NO: 754 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnctaagaggnntttttttttttttttttttttttttttttt

SEQ ID NO: 755 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnacgtgtagnntttttttttttttttttttttttttttttt

SEQ ID NO: 756 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnactacaggnntttttttttttttttttttttttttttttt

SEQ ID NO: 757 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntacaggtcnntttttttttttttttttttttttttttttt

SEQ ID NO: 758 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnctcacatgnntttttttttttttttttttttttttttttt

SEQ ID NO: 759 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnactaggagnntttttttttttttttttttttttttttttt

SEQ ID NO: 760 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnccatagganntttttttttttttttttttttttttttttt

SEQ ID NO: 761 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnggagaatcnntttttttttttttttttttttttttttttt

SEQ ID NO: 762 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngccaagaanntttttttttttttttttttttttttttttt

SEQ ID NO: 763 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnaaggcaagnntttttttttttttttttttttttttttttt

SEQ ID NO: 764 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnaatgtcgcnntttttttttttttttttttttttttttttt

SEQ ID NO: 765 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnatggaaccnntttttttttttttttttttttttttttttt

SEQ ID NO: 766 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnagaggcatnntttttttttttttttttttttttttttttt

SEQ ID NO: 767 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntgcatagcnntttttttttttttttttttttttttttttt

SEQ ID NO: 768 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnctaacgganntttttttttttttttttttttttttttttt

SEQ ID NO: 769 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntatcgaggnntttttttttttttttttttttttttttttt

SEQ ID NO: 770 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncatagcctnntttttttttttttttttttttttttttttt

SEQ ID NO: 771 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnatcgagacnntttttttttttttttttttttttttttttt

SEQ ID NO: 772 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnggaagagtnntttttttttttttttttttttttttttttt

SEQ ID NO: 773 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnccaagtagnntttttttttttttttttttttttttttttt

SEQ ID NO: 774 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnctgaacagnntttttttttttttttttttttttttttttt

SEQ ID NO: 775 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngtaggttcnntttttttttttttttttttttttttttttt

SEQ ID NO: 776 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngtatggacnntttttttttttttttttttttttttttttt

SEQ ID NO: 777 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntcgcaacanntttttttttttttttttttttttttttttt

SEQ ID NO: 778 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnccgctaatnntttttttttttttttttttttttttttttt

SEQ ID NO: 779 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngattcgcanntttttttttttttttttttttttttttttt

SEQ ID NO: 780 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncgatggaanntttttttttttttttttttttttttttttt

SEQ ID NO: 781 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnagcaagganntttttttttttttttttttttttttttttt

SEQ ID NO: 782 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncgtagcaanntttttttttttttttttttttttttttttt

SEQ ID NO: 783 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntggcagtanntttttttttttttttttttttttttttttt

SEQ ID NO: 784 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncggtagttnntttttttttttttttttttttttttttttt

SEQ ID NO: 785 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntgacttcgnntttttttttttttttttttttttttttttt

SEQ ID NO: 786 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngagtgcaanntttttttttttttttttttttttttttttt

SEQ ID NO: 787 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnacggtaacnntttttttttttttttttttttttttttttt

SEQ ID NO: 788 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnaagtggtgnntttttttttttttttttttttttttttttt

SEQ ID NO: 789 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnggagacaanntttttttttttttttttttttttttttttt

SEQ ID NO: 790 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntcaaggacnntttttttttttttttttttttttttttttt

SEQ ID NO: 791 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnaagagagcnntttttttttttttttttttttttttttttt

SEQ ID NO: 792 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncgagagatnntttttttttttttttttttttttttttttt

SEQ ID NO: 793 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnacagatggnntttttttttttttttttttttttttttttt

SEQ ID NO: 794 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnaggagtcanntttttttttttttttttttttttttttttt

SEQ ID NO: 795 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncgtgttacnntttttttttttttttttttttttttttttt

SEQ ID NO: 796 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntagtgtgcnntttttttttttttttttttttttttttttt

SEQ ID NO: 797 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnctcatgacnntttttttttttttttttttttttttttttt

SEQ ID NO: 798 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngtatccagnntttttttttttttttttttttttttttttt

SEQ ID NO: 799 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnacgcctatnntttttttttttttttttttttttttttttt

SEQ ID NO: 800 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnaacgacctnntttttttttttttttttttttttttttttt

SEQ ID NO: 801 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnatcaggctnntttttttttttttttttttttttttttttt

SEQ ID NO: 802 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncaagttcgnntttttttttttttttttttttttttttttt

SEQ ID NO: 803 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntagccaganntttttttttttttttttttttttttttttt

SEQ ID NO: 804 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncaatcacgnntttttttttttttttttttttttttttttt

SEQ ID NO: 805 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnngcaacaagnntttttttttttttttttttttttttttttt

SEQ ID NO: 806 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncacgacaanntttttttttttttttttttttttttttttt

SEQ ID NO: 807 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntacggaganntttttttttttttttttttttttttttttt

SEQ ID NO: 808 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncgacaaganntttttttttttttttttttttttttttttt

SEQ ID NO: 809 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncgaagtganntttttttttttttttttttttttttttttt

SEQ ID NO: 810 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnagctggtanntttttttttttttttttttttttttttttt

SEQ ID NO: 811 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnaactaggcnntttttttttttttttttttttttttttttt

SEQ ID NO: 812 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncagcaagtnntttttttttttttttttttttttttttttt

SEQ ID NO: 813 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnacgaggtanntttttttttttttttttttttttttttttt

SEQ ID NO: 814 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncatcttccnntttttttttttttttttttttttttttttt

SEQ ID NO: 815 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncctgaatcnntttttttttttttttttttttttttttttt

SEQ ID NO: 816 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnntgcagactnntttttttttttttttttttttttttttttt

SEQ ID NO: 817 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnagatgtggnntttttttttttttttttttttttttttttt

SEQ ID NO: 818 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnagttcgacnntttttttttttttttttttttttttttttt

SEQ ID NO: 819 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnnacaacctcnntttttttttttttttttttttttttttttt

SEQ ID NO: 820 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncatggtagnntttttttttttttttttttttttttttttt

SEQ ID NO: 821 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncgtatctcnntttttttttttttttttttttttttttttt

SEQ ID NO: 822 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncctagttcnntttttttttttttttttttttttttttttt

SEQ ID NO: 823 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggttagtgnncaagagtcnntttttttttttttttttttttttttttttt

SEQ ID NO: 824 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnaatcggcanntttttttttttttttttttttttttttttt

SEQ ID NO: 825 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntacggcatnntttttttttttttttttttttttttttttt

SEQ ID NO: 826 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnttggatcgnntttttttttttttttttttttttttttttt

SEQ ID NO: 827 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntggaacganntttttttttttttttttttttttttttttt

SEQ ID NO: 828 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnggcaatcanntttttttttttttttttttttttttttttt

SEQ ID NO: 829 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngaatccganntttttttttttttttttttttttttttttt

SEQ ID NO: 830 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnttacggtgnntttttttttttttttttttttttttttttt

SEQ ID NO: 831 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncatatcggnntttttttttttttttttttttttttttttt

SEQ ID NO: 832 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncttcggtanntttttttttttttttttttttttttttttt

SEQ ID NO: 833 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntcctaacgnntttttttttttttttttttttttttttttt

SEQ ID NO: 834 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngtaagccanntttttttttttttttttttttttttttttt

SEQ ID NO: 835 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntaaggtggnntttttttttttttttttttttttttttttt

SEQ ID NO: 836 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnggtaagctnntttttttttttttttttttttttttttttt

SEQ ID NO: 837 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntgtgtcganntttttttttttttttttttttttttttttt

SEQ ID NO: 838 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngagcatganntttttttttttttttttttttttttttttt

SEQ ID NO: 839 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntcgaagtcnntttttttttttttttttttttttttttttt

SEQ ID NO: 840 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnggtgaacanntttttttttttttttttttttttttttttt

SEQ ID NO: 841 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnacatgcacnntttttttttttttttttttttttttttttt

SEQ ID NO: 842 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnccaacagtnntttttttttttttttttttttttttttttt

SEQ ID NO: 843 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnagaacagcnntttttttttttttttttttttttttttttt

SEQ ID NO: 844 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngaacacgtnntttttttttttttttttttttttttttttt

SEQ ID NO: 845 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnggtcttcanntttttttttttttttttttttttttttttt

SEQ ID NO: 846 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnaggttcagnntttttttttttttttttttttttttttttt

SEQ ID NO: 847 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnctagagcanntttttttttttttttttttttttttttttt

SEQ ID NO: 848 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncttctagcnntttttttttttttttttttttttttttttt

SEQ ID NO: 849 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngagtaacgnntttttttttttttttttttttttttttttt

SEQ ID NO: 850 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnctaagaggnntttttttttttttttttttttttttttttt

SEQ ID NO: 851 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnacgtgtagnntttttttttttttttttttttttttttttt

SEQ ID NO: 852 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnactacaggnntttttttttttttttttttttttttttttt

SEQ ID NO: 853 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntacaggtcnntttttttttttttttttttttttttttttt

SEQ ID NO: 854 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnctcacatgnntttttttttttttttttttttttttttttt

SEQ ID NO: 855 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnactaggagnntttttttttttttttttttttttttttttt

SEQ ID NO: 856 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnccatagganntttttttttttttttttttttttttttttt

SEQ ID NO: 857 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnggagaatcnntttttttttttttttttttttttttttttt

SEQ ID NO: 858 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngccaagaanntttttttttttttttttttttttttttttt

SEQ ID NO: 859 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnaaggcaagnntttttttttttttttttttttttttttttt

SEQ ID NO: 860 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnaatgtcgcnntttttttttttttttttttttttttttttt

SEQ ID NO: 861 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnatggaaccnntttttttttttttttttttttttttttttt

SEQ ID NO: 862 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnagaggcatnntttttttttttttttttttttttttttttt

SEQ ID NO: 863 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntgcatagcnntttttttttttttttttttttttttttttt

SEQ ID NO: 864 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnctaacgganntttttttttttttttttttttttttttttt

SEQ ID NO: 865 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntatcgaggnntttttttttttttttttttttttttttttt

SEQ ID NO: 866 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncatagcctnntttttttttttttttttttttttttttttt

SEQ ID NO: 867 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnatcgagacnntttttttttttttttttttttttttttttt

SEQ ID NO: 868 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnggaagagtnntttttttttttttttttttttttttttttt

SEQ ID NO: 869 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnccaagtagnntttttttttttttttttttttttttttttt

SEQ ID NO: 870 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnctgaacagnntttttttttttttttttttttttttttttt

SEQ ID NO: 871 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngtaggttcnntttttttttttttttttttttttttttttt

SEQ ID NO: 872 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngtatggacnntttttttttttttttttttttttttttttt

SEQ ID NO: 873 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntcgcaacanntttttttttttttttttttttttttttttt

SEQ ID NO: 874 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnccgctaatnntttttttttttttttttttttttttttttt

SEQ ID NO: 875 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngattcgcanntttttttttttttttttttttttttttttt

SEQ ID NO: 876 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncgatggaanntttttttttttttttttttttttttttttt

SEQ ID NO: 877 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnagcaagganntttttttttttttttttttttttttttttt

SEQ ID NO: 878 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncgtagcaanntttttttttttttttttttttttttttttt

SEQ ID NO: 879 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntggcagtanntttttttttttttttttttttttttttttt

SEQ ID NO: 880 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncggtagttnntttttttttttttttttttttttttttttt

SEQ ID NO: 881 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntgacttcgnntttttttttttttttttttttttttttttt

SEQ ID NO: 882 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngagtgcaanntttttttttttttttttttttttttttttt

SEQ ID NO: 883 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnacggtaacnntttttttttttttttttttttttttttttt

SEQ ID NO: 884 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnaagtggtgnntttttttttttttttttttttttttttttt

SEQ ID NO: 885 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnggagacaanntttttttttttttttttttttttttttttt

SEQ ID NO: 886 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntcaaggacnntttttttttttttttttttttttttttttt

SEQ ID NO: 887 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnaagagagcnntttttttttttttttttttttttttttttt

SEQ ID NO: 888 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncgagagatnntttttttttttttttttttttttttttttt

SEQ ID NO: 889 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnacagatggnntttttttttttttttttttttttttttttt

SEQ ID NO: 890 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnaggagtcanntttttttttttttttttttttttttttttt

SEQ ID NO: 891 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncgtgttacnntttttttttttttttttttttttttttttt

SEQ ID NO: 892 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntagtgtgcnntttttttttttttttttttttttttttttt

SEQ ID NO: 893 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnctcatgacnntttttttttttttttttttttttttttttt

SEQ ID NO: 894 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngtatccagnntttttttttttttttttttttttttttttt

SEQ ID NO: 895 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnacgcctatnntttttttttttttttttttttttttttttt

SEQ ID NO: 896 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnaacgacctnntttttttttttttttttttttttttttttt

SEQ ID NO: 897 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnatcaggctnntttttttttttttttttttttttttttttt

SEQ ID NO: 898 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncaagttcgnntttttttttttttttttttttttttttttt

SEQ ID NO: 899 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntagccaganntttttttttttttttttttttttttttttt

SEQ ID NO: 900 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncaatcacgnntttttttttttttttttttttttttttttt

SEQ ID NO: 901 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnngcaacaagnntttttttttttttttttttttttttttttt

SEQ ID NO: 902 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncacgacaanntttttttttttttttttttttttttttttt

SEQ ID NO: 903 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntacggaganntttttttttttttttttttttttttttttt

SEQ ID NO: 904 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncgacaaganntttttttttttttttttttttttttttttt

SEQ ID NO: 905 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncgaagtganntttttttttttttttttttttttttttttt

SEQ ID NO: 906 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnagctggtanntttttttttttttttttttttttttttttt

SEQ ID NO: 907 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnaactaggcnntttttttttttttttttttttttttttttt

SEQ ID NO: 908 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncagcaagtnntttttttttttttttttttttttttttttt

SEQ ID NO: 909 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnacgaggtanntttttttttttttttttttttttttttttt

SEQ ID NO: 910 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncatcttccnntttttttttttttttttttttttttttttt

SEQ ID NO: 911 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncctgaatcnntttttttttttttttttttttttttttttt

SEQ ID NO: 912 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnntgcagactnntttttttttttttttttttttttttttttt

SEQ ID NO: 913 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnagatgtggnntttttttttttttttttttttttttttttt

SEQ ID NO: 914 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnagttcgacnntttttttttttttttttttttttttttttt

SEQ ID NO: 915 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnnacaacctcnntttttttttttttttttttttttttttttt

SEQ ID NO: 916 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncatggtagnntttttttttttttttttttttttttttttt

SEQ ID NO: 917 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncgtatctcnntttttttttttttttttttttttttttttt

SEQ ID NO: 918 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncctagttcnntttttttttttttttttttttttttttttt

SEQ ID NO: 919 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagttagnncaagagtcnntttttttttttttttttttttttttttttt

SEQ ID NO: 920 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnaatcggcanntttttttttttttttttttttttttttttt

SEQ ID NO: 921 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntacggcatnntttttttttttttttttttttttttttttt

SEQ ID NO: 922 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnttggatcgnntttttttttttttttttttttttttttttt

SEQ ID NO: 923 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntggaacganntttttttttttttttttttttttttttttt

SEQ ID NO: 924 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnggcaatcanntttttttttttttttttttttttttttttt

SEQ ID NO: 925 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngaatccganntttttttttttttttttttttttttttttt

SEQ ID NO: 926 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnttacggtgnntttttttttttttttttttttttttttttt

SEQ ID NO: 927 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncatatcggnntttttttttttttttttttttttttttttt

SEQ ID NO: 928 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncttcggtanntttttttttttttttttttttttttttttt

SEQ ID NO: 929 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntcctaacgnntttttttttttttttttttttttttttttt

SEQ ID NO: 930 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngtaagccanntttttttttttttttttttttttttttttt

SEQ ID NO: 931 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntaaggtggnntttttttttttttttttttttttttttttt

SEQ ID NO: 932 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnggtaagctnntttttttttttttttttttttttttttttt

SEQ ID NO: 933 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntgtgtcganntttttttttttttttttttttttttttttt

SEQ ID NO: 934 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngagcatganntttttttttttttttttttttttttttttt

SEQ ID NO: 935 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntcgaagtcnntttttttttttttttttttttttttttttt

SEQ ID NO: 936 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnggtgaacanntttttttttttttttttttttttttttttt

SEQ ID NO: 937 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnacatgcacnntttttttttttttttttttttttttttttt

SEQ ID NO: 938 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnccaacagtnntttttttttttttttttttttttttttttt

SEQ ID NO: 939 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnagaacagcnntttttttttttttttttttttttttttttt

SEQ ID NO: 940 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngaacacgtnntttttttttttttttttttttttttttttt

SEQ ID NO: 941 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnggtcttcanntttttttttttttttttttttttttttttt

SEQ ID NO: 942 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnaggttcagnntttttttttttttttttttttttttttttt

SEQ ID NO: 943 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnctagagcanntttttttttttttttttttttttttttttt

SEQ ID NO: 944 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncttctagcnntttttttttttttttttttttttttttttt

SEQ ID NO: 945 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngagtaacgnntttttttttttttttttttttttttttttt

SEQ ID NO: 946 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnctaagaggnntttttttttttttttttttttttttttttt

SEQ ID NO: 947 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnacgtgtagnntttttttttttttttttttttttttttttt

SEQ ID NO: 948 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnactacaggnntttttttttttttttttttttttttttttt

SEQ ID NO: 949 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntacaggtcnntttttttttttttttttttttttttttttt

SEQ ID NO: 950 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnctcacatgnntttttttttttttttttttttttttttttt

SEQ ID NO: 951 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnactaggagnntttttttttttttttttttttttttttttt

SEQ ID NO: 952 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnccatagganntttttttttttttttttttttttttttttt

SEQ ID NO: 953 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnggagaatcnntttttttttttttttttttttttttttttt

SEQ ID NO: 954 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngccaagaanntttttttttttttttttttttttttttttt

SEQ ID NO: 955 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnaaggcaagnntttttttttttttttttttttttttttttt

SEQ ID NO: 956 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnaatgtcgcnntttttttttttttttttttttttttttttt

SEQ ID NO: 957 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnatggaaccnntttttttttttttttttttttttttttttt

SEQ ID NO: 958 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnagaggcatnntttttttttttttttttttttttttttttt

SEQ ID NO: 959 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntgcatagcnntttttttttttttttttttttttttttttt

SEQ ID NO: 960 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnctaacgganntttttttttttttttttttttttttttttt

SEQ ID NO: 961 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntatcgaggnntttttttttttttttttttttttttttttt

SEQ ID NO: 962 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncatagcctnntttttttttttttttttttttttttttttt

SEQ ID NO: 963 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnatcgagacnntttttttttttttttttttttttttttttt

SEQ ID NO: 964 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnggaagagtnntttttttttttttttttttttttttttttt

SEQ ID NO: 965 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnccaagtagnntttttttttttttttttttttttttttttt

SEQ ID NO: 966 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnctgaacagnntttttttttttttttttttttttttttttt

SEQ ID NO: 967 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngtaggttcnntttttttttttttttttttttttttttttt

SEQ ID NO: 968 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngtatggacnntttttttttttttttttttttttttttttt

SEQ ID NO: 969 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntcgcaacanntttttttttttttttttttttttttttttt

SEQ ID NO: 970 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnccgctaatnntttttttttttttttttttttttttttttt

SEQ ID NO: 971 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngattcgcanntttttttttttttttttttttttttttttt

SEQ ID NO: 972 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncgatggaanntttttttttttttttttttttttttttttt

SEQ ID NO: 973 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnagcaagganntttttttttttttttttttttttttttttt

SEQ ID NO: 974 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncgtagcaanntttttttttttttttttttttttttttttt

SEQ ID NO: 975 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntggcagtanntttttttttttttttttttttttttttttt

SEQ ID NO: 976 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncggtagttnntttttttttttttttttttttttttttttt

SEQ ID NO: 977 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntgacttcgnntttttttttttttttttttttttttttttt

SEQ ID NO: 978 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngagtgcaanntttttttttttttttttttttttttttttt

SEQ ID NO: 979 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnacggtaacnntttttttttttttttttttttttttttttt

SEQ ID NO: 980 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnaagtggtgnntttttttttttttttttttttttttttttt

SEQ ID NO: 981 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnggagacaanntttttttttttttttttttttttttttttt

SEQ ID NO: 982 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntcaaggacnntttttttttttttttttttttttttttttt

SEQ ID NO: 983 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnaagagagcnntttttttttttttttttttttttttttttt

SEQ ID NO: 984 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncgagagatnntttttttttttttttttttttttttttttt

SEQ ID NO: 985 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnacagatggnntttttttttttttttttttttttttttttt

SEQ ID NO: 986 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnaggagtcanntttttttttttttttttttttttttttttt

SEQ ID NO: 987 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncgtgttacnntttttttttttttttttttttttttttttt

SEQ ID NO: 988 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntagtgtgcnntttttttttttttttttttttttttttttt

SEQ ID NO: 989 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnctcatgacnntttttttttttttttttttttttttttttt

SEQ ID NO: 990 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngtatccagnntttttttttttttttttttttttttttttt

SEQ ID NO: 991 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnacgcctatnntttttttttttttttttttttttttttttt

SEQ ID NO: 992 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnaacgacctnntttttttttttttttttttttttttttttt

SEQ ID NO: 993 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnatcaggctnntttttttttttttttttttttttttttttt

SEQ ID NO: 994 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncaagttcgnntttttttttttttttttttttttttttttt

SEQ ID NO: 995 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntagccaganntttttttttttttttttttttttttttttt

SEQ ID NO: 996 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncaatcacgnntttttttttttttttttttttttttttttt

SEQ ID NO: 997 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnngcaacaagnntttttttttttttttttttttttttttttt

SEQ ID NO: 998 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncacgacaanntttttttttttttttttttttttttttttt

SEQ ID NO: 999 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntacggaganntttttttttttttttttttttttttttttt

SEQ ID NO: 1000 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncgacaaganntttttttttttttttttttttttttttttt

SEQ ID NO: 1001 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncgaagtganntttttttttttttttttttttttttttttt

SEQ ID NO: 1002 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnagctggtanntttttttttttttttttttttttttttttt

SEQ ID NO: 1003 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnaactaggcnntttttttttttttttttttttttttttttt

SEQ ID NO: 1004 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncagcaagtnntttttttttttttttttttttttttttttt

SEQ ID NO: 1005 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnacgaggtanntttttttttttttttttttttttttttttt

SEQ ID NO: 1006 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncatcttccnntttttttttttttttttttttttttttttt

SEQ ID NO: 1007 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncctgaatcnntttttttttttttttttttttttttttttt

SEQ ID NO: 1008 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnntgcagactnntttttttttttttttttttttttttttttt

SEQ ID NO: 1009 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnagatgtggnntttttttttttttttttttttttttttttt

SEQ ID NO: 1010 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnagttcgacnntttttttttttttttttttttttttttttt

SEQ ID NO: 1011 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnnacaacctcnntttttttttttttttttttttttttttttt

SEQ ID NO: 1012 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncatggtagnntttttttttttttttttttttttttttttt

SEQ ID NO: 1013 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncgtatctcnntttttttttttttttttttttttttttttt

SEQ ID NO: 1014 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncctagttcnntttttttttttttttttttttttttttttt

SEQ ID NO: 1015 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtgtgtgnncaagagtcnntttttttttttttttttttttttttttttt

SEQ ID NO: 1016 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannaatcggcanntttttttttttttttttttttttttttttt

SEQ ID NO: 1017 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntacggcatnntttttttttttttttttttttttttttttt

SEQ ID NO: 1018 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannttggatcgnntttttttttttttttttttttttttttttt

SEQ ID NO: 1019 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntggaacganntttttttttttttttttttttttttttttt

SEQ ID NO: 1020 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannggcaatcanntttttttttttttttttttttttttttttt

SEQ ID NO: 1021 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngaatccganntttttttttttttttttttttttttttttt

SEQ ID NO: 1022 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannttacggtgnntttttttttttttttttttttttttttttt

SEQ ID NO: 1023 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncatatcggnntttttttttttttttttttttttttttttt

SEQ ID NO: 1024 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncttcggtanntttttttttttttttttttttttttttttt

SEQ ID NO: 1025 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntcctaacgnntttttttttttttttttttttttttttttt

SEQ ID NO: 1026 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngtaagccanntttttttttttttttttttttttttttttt

SEQ ID NO: 1027 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntaaggtggnntttttttttttttttttttttttttttttt

SEQ ID NO: 1028 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannggtaagctnntttttttttttttttttttttttttttttt

SEQ ID NO: 1029 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntgtgtcganntttttttttttttttttttttttttttttt

SEQ ID NO: 1030 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngagcatganntttttttttttttttttttttttttttttt

SEQ ID NO: 1031 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntcgaagtcnntttttttttttttttttttttttttttttt

SEQ ID NO: 1032 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannggtgaacanntttttttttttttttttttttttttttttt

SEQ ID NO: 1033 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannacatgcacnntttttttttttttttttttttttttttttt

SEQ ID NO: 1034 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannccaacagtnntttttttttttttttttttttttttttttt

SEQ ID NO: 1035 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannagaacagcnntttttttttttttttttttttttttttttt

SEQ ID NO: 1036 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngaacacgtnntttttttttttttttttttttttttttttt

SEQ ID NO: 1037 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannggtcttcanntttttttttttttttttttttttttttttt

SEQ ID NO: 1038 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannaggttcagnntttttttttttttttttttttttttttttt

SEQ ID NO: 1039 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannctagagcanntttttttttttttttttttttttttttttt

SEQ ID NO: 1040 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncttctagcnntttttttttttttttttttttttttttttt

SEQ ID NO: 1041 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngagtaacgnntttttttttttttttttttttttttttttt

SEQ ID NO: 1042 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannctaagaggnntttttttttttttttttttttttttttttt

SEQ ID NO: 1043 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannacgtgtagnntttttttttttttttttttttttttttttt

SEQ ID NO: 1044 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannactacaggnntttttttttttttttttttttttttttttt

SEQ ID NO: 1045 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntacaggtcnntttttttttttttttttttttttttttttt

SEQ ID NO: 1046 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannctcacatgnntttttttttttttttttttttttttttttt

SEQ ID NO: 1047 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannactaggagnntttttttttttttttttttttttttttttt

SEQ ID NO: 1048 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannccatagganntttttttttttttttttttttttttttttt

SEQ ID NO: 1049 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannggagaatcnntttttttttttttttttttttttttttttt

SEQ ID NO: 1050 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngccaagaanntttttttttttttttttttttttttttttt

SEQ ID NO: 1051 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannaaggcaagnntttttttttttttttttttttttttttttt

SEQ ID NO: 1052 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannaatgtcgcnntttttttttttttttttttttttttttttt

SEQ ID NO: 1053 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannatggaaccnntttttttttttttttttttttttttttttt

SEQ ID NO: 1054 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannagaggcatnntttttttttttttttttttttttttttttt

SEQ ID NO: 1055 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntgcatagcnntttttttttttttttttttttttttttttt

SEQ ID NO: 1056 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannctaacgganntttttttttttttttttttttttttttttt

SEQ ID NO: 1057 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntatcgaggnntttttttttttttttttttttttttttttt

SEQ ID NO: 1058 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncatagcctnntttttttttttttttttttttttttttttt

SEQ ID NO: 1059 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannatcgagacnntttttttttttttttttttttttttttttt

SEQ ID NO: 1060 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannggaagagtnntttttttttttttttttttttttttttttt

SEQ ID NO: 1061 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannccaagtagnntttttttttttttttttttttttttttttt

SEQ ID NO: 1062 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannctgaacagnntttttttttttttttttttttttttttttt

SEQ ID NO: 1063 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngtaggttcnntttttttttttttttttttttttttttttt

SEQ ID NO: 1064 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngtatggacnntttttttttttttttttttttttttttttt

SEQ ID NO: 1065 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntcgcaacanntttttttttttttttttttttttttttttt

SEQ ID NO: 1066 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannccgctaatnntttttttttttttttttttttttttttttt

SEQ ID NO: 1067 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngattcgcanntttttttttttttttttttttttttttttt

SEQ ID NO: 1068 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncgatggaanntttttttttttttttttttttttttttttt

SEQ ID NO: 1069 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannagcaagganntttttttttttttttttttttttttttttt

SEQ ID NO: 1070 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncgtagcaanntttttttttttttttttttttttttttttt

SEQ ID NO: 1071 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntggcagtanntttttttttttttttttttttttttttttt

SEQ ID NO: 1072 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncggtagttnntttttttttttttttttttttttttttttt

SEQ ID NO: 1073 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntgacttcgnntttttttttttttttttttttttttttttt

SEQ ID NO: 1074 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngagtgcaanntttttttttttttttttttttttttttttt

SEQ ID NO: 1075 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannacggtaacnntttttttttttttttttttttttttttttt

SEQ ID NO: 1076 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannaagtggtgnntttttttttttttttttttttttttttttt

SEQ ID NO: 1077 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannggagacaanntttttttttttttttttttttttttttttt

SEQ ID NO: 1078 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntcaaggacnntttttttttttttttttttttttttttttt

SEQ ID NO: 1079 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannaagagagcnntttttttttttttttttttttttttttttt

SEQ ID NO: 1080 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncgagagatnntttttttttttttttttttttttttttttt

SEQ ID NO: 1081 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannacagatggnntttttttttttttttttttttttttttttt

SEQ ID NO: 1082 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannaggagtcanntttttttttttttttttttttttttttttt

SEQ ID NO: 1083 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncgtgttacnntttttttttttttttttttttttttttttt

SEQ ID NO: 1084 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntagtgtgcnntttttttttttttttttttttttttttttt

SEQ ID NO: 1085 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannctcatgacnntttttttttttttttttttttttttttttt

SEQ ID NO: 1086 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngtatccagnntttttttttttttttttttttttttttttt

SEQ ID NO: 1087 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannacgcctatnntttttttttttttttttttttttttttttt

SEQ ID NO: 1088 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannaacgacctnntttttttttttttttttttttttttttttt

SEQ ID NO: 1089 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannatcaggctnntttttttttttttttttttttttttttttt

SEQ ID NO: 1090 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncaagttcgnntttttttttttttttttttttttttttttt

SEQ ID NO: 1091 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntagccaganntttttttttttttttttttttttttttttt

SEQ ID NO: 1092 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncaatcacgnntttttttttttttttttttttttttttttt

SEQ ID NO: 1093 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanngcaacaagnntttttttttttttttttttttttttttttt

SEQ ID NO: 1094 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncacgacaanntttttttttttttttttttttttttttttt

SEQ ID NO: 1095 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntacggaganntttttttttttttttttttttttttttttt

SEQ ID NO: 1096 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncgacaaganntttttttttttttttttttttttttttttt

SEQ ID NO: 1097 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncgaagtganntttttttttttttttttttttttttttttt

SEQ ID NO: 1098 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannagctggtanntttttttttttttttttttttttttttttt

SEQ ID NO: 1099 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannaactaggcnntttttttttttttttttttttttttttttt

SEQ ID NO: 1100 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncagcaagtnntttttttttttttttttttttttttttttt

SEQ ID NO: 1101 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannacgaggtanntttttttttttttttttttttttttttttt

SEQ ID NO: 1102 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncatcttccnntttttttttttttttttttttttttttttt

SEQ ID NO: 1103 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncctgaatcnntttttttttttttttttttttttttttttt

SEQ ID NO: 1104 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanntgcagactnntttttttttttttttttttttttttttttt

SEQ ID NO: 1105 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannagatgtggnntttttttttttttttttttttttttttttt

SEQ ID NO: 1106 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannagttcgacnntttttttttttttttttttttttttttttt

SEQ ID NO: 1107 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaannacaacctcnntttttttttttttttttttttttttttttt

SEQ ID NO: 1108 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncatggtagnntttttttttttttttttttttttttttttt

SEQ ID NO: 1109 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncgtatctcnntttttttttttttttttttttttttttttt

SEQ ID NO: 1110 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncctagttcnntttttttttttttttttttttttttttttt

SEQ ID NO: 1111 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggcctaanncaagagtcnntttttttttttttttttttttttttttttt

SEQ ID NO: 1112 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannaatcggcanntttttttttttttttttttttttttttttt

SEQ ID NO: 1113 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntacggcatnntttttttttttttttttttttttttttttt

SEQ ID NO: 1114 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannttggatcgnntttttttttttttttttttttttttttttt

SEQ ID NO: 1115 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntggaacganntttttttttttttttttttttttttttttt

SEQ ID NO: 1116 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannggcaatcanntttttttttttttttttttttttttttttt

SEQ ID NO: 1117 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngaatccganntttttttttttttttttttttttttttttt

SEQ ID NO: 1118 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannttacggtgnntttttttttttttttttttttttttttttt

SEQ ID NO: 1119 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncatatcggnntttttttttttttttttttttttttttttt

SEQ ID NO: 1120 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncttcggtanntttttttttttttttttttttttttttttt

SEQ ID NO: 1121 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntcctaacgnntttttttttttttttttttttttttttttt

SEQ ID NO: 1122 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngtaagccanntttttttttttttttttttttttttttttt

SEQ ID NO: 1123 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntaaggtggnntttttttttttttttttttttttttttttt

SEQ ID NO: 1124 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannggtaagctnntttttttttttttttttttttttttttttt

SEQ ID NO: 1125 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntgtgtcganntttttttttttttttttttttttttttttt

SEQ ID NO: 1126 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngagcatganntttttttttttttttttttttttttttttt

SEQ ID NO: 1127 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntcgaagtcnntttttttttttttttttttttttttttttt

SEQ ID NO: 1128 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannggtgaacanntttttttttttttttttttttttttttttt

SEQ ID NO: 1129 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannacatgcacnntttttttttttttttttttttttttttttt

SEQ ID NO: 1130 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannccaacagtnntttttttttttttttttttttttttttttt

SEQ ID NO: 1131 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannagaacagcnntttttttttttttttttttttttttttttt

SEQ ID NO: 1132 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngaacacgtnntttttttttttttttttttttttttttttt

SEQ ID NO: 1133 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannggtcttcanntttttttttttttttttttttttttttttt

SEQ ID NO: 1134 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannaggttcagnntttttttttttttttttttttttttttttt

SEQ ID NO: 1135 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannctagagcanntttttttttttttttttttttttttttttt

SEQ ID NO: 1136 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncttctagcnntttttttttttttttttttttttttttttt

SEQ ID NO: 1137 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngagtaacgnntttttttttttttttttttttttttttttt

SEQ ID NO: 1138 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannctaagaggnntttttttttttttttttttttttttttttt

SEQ ID NO: 1139 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannacgtgtagnntttttttttttttttttttttttttttttt

SEQ ID NO: 1140 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannactacaggnntttttttttttttttttttttttttttttt

SEQ ID NO: 1141 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntacaggtcnntttttttttttttttttttttttttttttt

SEQ ID NO: 1142 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannctcacatgnntttttttttttttttttttttttttttttt

SEQ ID NO: 1143 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannactaggagnntttttttttttttttttttttttttttttt

SEQ ID NO: 1144 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannccatagganntttttttttttttttttttttttttttttt

SEQ ID NO: 1145 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannggagaatcnntttttttttttttttttttttttttttttt

SEQ ID NO: 1146 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngccaagaanntttttttttttttttttttttttttttttt

SEQ ID NO: 1147 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannaaggcaagnntttttttttttttttttttttttttttttt

SEQ ID NO: 1148 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannaatgtcgcnntttttttttttttttttttttttttttttt

SEQ ID NO: 1149 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannatggaaccnntttttttttttttttttttttttttttttt

SEQ ID NO: 1150 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannagaggcatnntttttttttttttttttttttttttttttt

SEQ ID NO: 1151 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntgcatagcnntttttttttttttttttttttttttttttt

SEQ ID NO: 1152 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannctaacgganntttttttttttttttttttttttttttttt

SEQ ID NO: 1153 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntatcgaggnntttttttttttttttttttttttttttttt

SEQ ID NO: 1154 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncatagcctnntttttttttttttttttttttttttttttt

SEQ ID NO: 1155 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannatcgagacnntttttttttttttttttttttttttttttt

SEQ ID NO: 1156 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannggaagagtnntttttttttttttttttttttttttttttt

SEQ ID NO: 1157 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannccaagtagnntttttttttttttttttttttttttttttt

SEQ ID NO: 1158 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannctgaacagnntttttttttttttttttttttttttttttt

SEQ ID NO: 1159 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngtaggttcnntttttttttttttttttttttttttttttt

SEQ ID NO: 1160 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngtatggacnntttttttttttttttttttttttttttttt

SEQ ID NO: 1161 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntcgcaacanntttttttttttttttttttttttttttttt

SEQ ID NO: 1162 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannccgctaatnntttttttttttttttttttttttttttttt

SEQ ID NO: 1163 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngattcgcanntttttttttttttttttttttttttttttt

SEQ ID NO: 1164 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncgatggaanntttttttttttttttttttttttttttttt

SEQ ID NO: 1165 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannagcaagganntttttttttttttttttttttttttttttt

SEQ ID NO: 1166 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncgtagcaanntttttttttttttttttttttttttttttt

SEQ ID NO: 1167 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntggcagtanntttttttttttttttttttttttttttttt

SEQ ID NO: 1168 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncggtagttnntttttttttttttttttttttttttttttt

SEQ ID NO: 1169 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntgacttcgnntttttttttttttttttttttttttttttt

SEQ ID NO: 1170 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngagtgcaanntttttttttttttttttttttttttttttt

SEQ ID NO: 1171 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannacggtaacnntttttttttttttttttttttttttttttt

SEQ ID NO: 1172 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannaagtggtgnntttttttttttttttttttttttttttttt

SEQ ID NO: 1173 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannggagacaanntttttttttttttttttttttttttttttt

SEQ ID NO: 1174 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntcaaggacnntttttttttttttttttttttttttttttt

SEQ ID NO: 1175 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannaagagagcnntttttttttttttttttttttttttttttt

SEQ ID NO: 1176 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncgagagatnntttttttttttttttttttttttttttttt

SEQ ID NO: 1177 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannacagatggnntttttttttttttttttttttttttttttt

SEQ ID NO: 1178 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannaggagtcanntttttttttttttttttttttttttttttt

SEQ ID NO: 1179 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncgtgttacnntttttttttttttttttttttttttttttt

SEQ ID NO: 1180 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntagtgtgcnntttttttttttttttttttttttttttttt

SEQ ID NO: 1181 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannctcatgacnntttttttttttttttttttttttttttttt

SEQ ID NO: 1182 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngtatccagnntttttttttttttttttttttttttttttt

SEQ ID NO: 1183 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannacgcctatnntttttttttttttttttttttttttttttt

SEQ ID NO: 1184 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannaacgacctnntttttttttttttttttttttttttttttt

SEQ ID NO: 1185 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannatcaggctnntttttttttttttttttttttttttttttt

SEQ ID NO: 1186 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncaagttcgnntttttttttttttttttttttttttttttt

SEQ ID NO: 1187 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntagccaganntttttttttttttttttttttttttttttt

SEQ ID NO: 1188 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncaatcacgnntttttttttttttttttttttttttttttt

SEQ ID NO: 1189 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanngcaacaagnntttttttttttttttttttttttttttttt

SEQ ID NO: 1190 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncacgacaanntttttttttttttttttttttttttttttt

SEQ ID NO: 1191 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntacggaganntttttttttttttttttttttttttttttt

SEQ ID NO: 1192 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncgacaaganntttttttttttttttttttttttttttttt

SEQ ID NO: 1193 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncgaagtganntttttttttttttttttttttttttttttt

SEQ ID NO: 1194 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannagctggtanntttttttttttttttttttttttttttttt

SEQ ID NO: 1195 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannaactaggcnntttttttttttttttttttttttttttttt

SEQ ID NO: 1196 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncagcaagtnntttttttttttttttttttttttttttttt

SEQ ID NO: 1197 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannacgaggtanntttttttttttttttttttttttttttttt

SEQ ID NO: 1198 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncatcttccnntttttttttttttttttttttttttttttt

SEQ ID NO: 1199 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncctgaatcnntttttttttttttttttttttttttttttt

SEQ ID NO: 1200 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanntgcagactnntttttttttttttttttttttttttttttt

SEQ ID NO: 1201 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannagatgtggnntttttttttttttttttttttttttttttt

SEQ ID NO: 1202 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannagttcgacnntttttttttttttttttttttttttttttt

SEQ ID NO: 1203 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaannacaacctcnntttttttttttttttttttttttttttttt

SEQ ID NO: 1204 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncatggtagnntttttttttttttttttttttttttttttt

SEQ ID NO: 1205 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncgtatctcnntttttttttttttttttttttttttttttt

SEQ ID NO: 1206 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncctagttcnntttttttttttttttttttttttttttttt

SEQ ID NO: 1207 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcggacaanncaagagtcnntttttttttttttttttttttttttttttt

SEQ ID NO: 1208 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnaatcggcanntttttttttttttttttttttttttttttt

SEQ ID NO: 1209 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntacggcatnntttttttttttttttttttttttttttttt

SEQ ID NO: 1210 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnttggatcgnntttttttttttttttttttttttttttttt

SEQ ID NO: 1211 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntggaacganntttttttttttttttttttttttttttttt

SEQ ID NO: 1212 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnggcaatcanntttttttttttttttttttttttttttttt

SEQ ID NO: 1213 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngaatccganntttttttttttttttttttttttttttttt

SEQ ID NO: 1214 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnttacggtgnntttttttttttttttttttttttttttttt

SEQ ID NO: 1215 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncatatcggnntttttttttttttttttttttttttttttt

SEQ ID NO: 1216 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncttcggtanntttttttttttttttttttttttttttttt

SEQ ID NO: 1217 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntcctaacgnntttttttttttttttttttttttttttttt

SEQ ID NO: 1218 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngtaagccanntttttttttttttttttttttttttttttt

SEQ ID NO: 1219 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntaaggtggnntttttttttttttttttttttttttttttt

SEQ ID NO: 1220 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnggtaagctnntttttttttttttttttttttttttttttt

SEQ ID NO: 1221 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntgtgtcganntttttttttttttttttttttttttttttt

SEQ ID NO: 1222 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngagcatganntttttttttttttttttttttttttttttt

SEQ ID NO: 1223 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntcgaagtcnntttttttttttttttttttttttttttttt

SEQ ID NO: 1224 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnggtgaacanntttttttttttttttttttttttttttttt

SEQ ID NO: 1225 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnacatgcacnntttttttttttttttttttttttttttttt

SEQ ID NO: 1226 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnccaacagtnntttttttttttttttttttttttttttttt

SEQ ID NO: 1227 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnagaacagcnntttttttttttttttttttttttttttttt

SEQ ID NO: 1228 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngaacacgtnntttttttttttttttttttttttttttttt

SEQ ID NO: 1229 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnggtcttcanntttttttttttttttttttttttttttttt

SEQ ID NO: 1230 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnaggttcagnntttttttttttttttttttttttttttttt

SEQ ID NO: 1231 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnctagagcanntttttttttttttttttttttttttttttt

SEQ ID NO: 1232 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncttctagcnntttttttttttttttttttttttttttttt

SEQ ID NO: 1233 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngagtaacgnntttttttttttttttttttttttttttttt

SEQ ID NO: 1234 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnctaagaggnntttttttttttttttttttttttttttttt

SEQ ID NO: 1235 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnacgtgtagnntttttttttttttttttttttttttttttt

SEQ ID NO: 1236 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnactacaggnntttttttttttttttttttttttttttttt

SEQ ID NO: 1237 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntacaggtcnntttttttttttttttttttttttttttttt

SEQ ID NO: 1238 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnctcacatgnntttttttttttttttttttttttttttttt

SEQ ID NO: 1239 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnactaggagnntttttttttttttttttttttttttttttt

SEQ ID NO: 1240 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnccatagganntttttttttttttttttttttttttttttt

SEQ ID NO: 1241 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnggagaatcnntttttttttttttttttttttttttttttt

SEQ ID NO: 1242 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngccaagaanntttttttttttttttttttttttttttttt

SEQ ID NO: 1243 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnaaggcaagnntttttttttttttttttttttttttttttt

SEQ ID NO: 1244 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnaatgtcgcnntttttttttttttttttttttttttttttt

SEQ ID NO: 1245 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnatggaaccnntttttttttttttttttttttttttttttt

SEQ ID NO: 1246 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnagaggcatnntttttttttttttttttttttttttttttt

SEQ ID NO: 1247 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntgcatagcnntttttttttttttttttttttttttttttt

SEQ ID NO: 1248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnctaacgganntttttttttttttttttttttttttttttt

SEQ ID NO: 1249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntatcgaggnntttttttttttttttttttttttttttttt

SEQ ID NO: 1250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncatagcctnntttttttttttttttttttttttttttttt

SEQ ID NO: 1251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnatcgagacnntttttttttttttttttttttttttttttt

SEQ ID NO: 1252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnggaagagtnntttttttttttttttttttttttttttttt

SEQ ID NO: 1253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnccaagtagnntttttttttttttttttttttttttttttt

SEQ ID NO: 1254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnctgaacagnntttttttttttttttttttttttttttttt

SEQ ID NO: 1255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngtaggttcnntttttttttttttttttttttttttttttt

SEQ ID NO: 1256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngtatggacnntttttttttttttttttttttttttttttt

SEQ ID NO: 1257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntcgcaacanntttttttttttttttttttttttttttttt

SEQ ID NO: 1258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnccgctaatnntttttttttttttttttttttttttttttt

SEQ ID NO: 1259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngattcgcanntttttttttttttttttttttttttttttt

SEQ ID NO: 1260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncgatggaanntttttttttttttttttttttttttttttt

SEQ ID NO: 1261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnagcaagganntttttttttttttttttttttttttttttt

SEQ ID NO: 1262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncgtagcaanntttttttttttttttttttttttttttttt

SEQ ID NO: 1263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntggcagtanntttttttttttttttttttttttttttttt

SEQ ID NO: 1264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncggtagttnntttttttttttttttttttttttttttttt

SEQ ID NO: 1265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntgacttcgnntttttttttttttttttttttttttttttt

SEQ ID NO: 1266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngagtgcaanntttttttttttttttttttttttttttttt

SEQ ID NO: 1267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnacggtaacnntttttttttttttttttttttttttttttt

SEQ ID NO: 1268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnaagtggtgnntttttttttttttttttttttttttttttt

SEQ ID NO: 1269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnggagacaanntttttttttttttttttttttttttttttt

SEQ ID NO: 1270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntcaaggacnntttttttttttttttttttttttttttttt

SEQ ID NO: 1271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnaagagagcnntttttttttttttttttttttttttttttt

SEQ ID NO: 1272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncgagagatnntttttttttttttttttttttttttttttt

SEQ ID NO: 1273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnacagatggnntttttttttttttttttttttttttttttt

SEQ ID NO: 1274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnaggagtcanntttttttttttttttttttttttttttttt

SEQ ID NO: 1275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncgtgttacnntttttttttttttttttttttttttttttt

SEQ ID NO: 1276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntagtgtgcnntttttttttttttttttttttttttttttt

SEQ ID NO: 1277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnctcatgacnntttttttttttttttttttttttttttttt

SEQ ID NO: 1278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngtatccagnntttttttttttttttttttttttttttttt

SEQ ID NO: 1279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnacgcctatnntttttttttttttttttttttttttttttt

SEQ ID NO: 1280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnaacgacctnntttttttttttttttttttttttttttttt

SEQ ID NO: 1281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnatcaggctnntttttttttttttttttttttttttttttt

SEQ ID NO: 1282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncaagttcgnntttttttttttttttttttttttttttttt

SEQ ID NO: 1283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntagccaganntttttttttttttttttttttttttttttt

SEQ ID NO: 1284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncaatcacgnntttttttttttttttttttttttttttttt

SEQ ID NO: 1285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnngcaacaagnntttttttttttttttttttttttttttttt

SEQ ID NO: 1286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncacgacaanntttttttttttttttttttttttttttttt

SEQ ID NO: 1287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntacggaganntttttttttttttttttttttttttttttt

SEQ ID NO: 1288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncgacaaganntttttttttttttttttttttttttttttt

SEQ ID NO: 1289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncgaagtganntttttttttttttttttttttttttttttt

SEQ ID NO: 1290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnagctggtanntttttttttttttttttttttttttttttt

SEQ ID NO: 1291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnaactaggcnntttttttttttttttttttttttttttttt

SEQ ID NO: 1292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncagcaagtnntttttttttttttttttttttttttttttt

SEQ ID NO: 1293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnacgaggtanntttttttttttttttttttttttttttttt

SEQ ID NO: 1294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncatcttccnntttttttttttttttttttttttttttttt

SEQ ID NO: 1295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncctgaatcnntttttttttttttttttttttttttttttt

SEQ ID NO: 1296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnntgcagactnntttttttttttttttttttttttttttttt

SEQ ID NO: 1297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnagatgtggnntttttttttttttttttttttttttttttt

SEQ ID NO: 1298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnagttcgacnntttttttttttttttttttttttttttttt

SEQ ID NO: 1299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnnacaacctcnntttttttttttttttttttttttttttttt

SEQ ID NO: 1300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncatggtagnntttttttttttttttttttttttttttttt

SEQ ID NO: 1301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncgtatctcnntttttttttttttttttttttttttttttt

SEQ ID NO: 1302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncctagttcnntttttttttttttttttttttttttttttt

SEQ ID NO: 1303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattgtccgnncaagagtcnntttttttttttttttttttttttttttttt

SEQ ID NO: 1304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnaatcggcanntttttttttttttttttttttttttttttt

SEQ ID NO: 1305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntacggcatnntttttttttttttttttttttttttttttt

SEQ ID NO: 1306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnttggatcgnntttttttttttttttttttttttttttttt

SEQ ID NO: 1307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntggaacganntttttttttttttttttttttttttttttt

SEQ ID NO: 1308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnggcaatcanntttttttttttttttttttttttttttttt

SEQ ID NO: 1309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngaatccganntttttttttttttttttttttttttttttt

SEQ ID NO: 1310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnttacggtgnntttttttttttttttttttttttttttttt

SEQ ID NO: 1311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncatatcggnntttttttttttttttttttttttttttttt

SEQ ID NO: 1312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncttcggtanntttttttttttttttttttttttttttttt

SEQ ID NO: 1313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntcctaacgnntttttttttttttttttttttttttttttt

SEQ ID NO: 1314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngtaagccanntttttttttttttttttttttttttttttt

SEQ ID NO: 1315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntaaggtggnntttttttttttttttttttttttttttttt

SEQ ID NO: 1316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnggtaagctnntttttttttttttttttttttttttttttt

SEQ ID NO: 1317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntgtgtcganntttttttttttttttttttttttttttttt

SEQ ID NO: 1318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngagcatganntttttttttttttttttttttttttttttt

SEQ ID NO: 1319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntcgaagtcnntttttttttttttttttttttttttttttt

SEQ ID NO: 1320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnggtgaacanntttttttttttttttttttttttttttttt

SEQ ID NO: 1321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnacatgcacnntttttttttttttttttttttttttttttt

SEQ ID NO: 1322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnccaacagtnntttttttttttttttttttttttttttttt

SEQ ID NO: 1323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnagaacagcnntttttttttttttttttttttttttttttt

SEQ ID NO: 1324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngaacacgtnntttttttttttttttttttttttttttttt

SEQ ID NO: 1325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnggtcttcanntttttttttttttttttttttttttttttt

SEQ ID NO: 1326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnaggttcagnntttttttttttttttttttttttttttttt

SEQ ID NO: 1327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnctagagcanntttttttttttttttttttttttttttttt

SEQ ID NO: 1328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncttctagcnntttttttttttttttttttttttttttttt

SEQ ID NO: 1329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngagtaacgnntttttttttttttttttttttttttttttt

SEQ ID NO: 1330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnctaagaggnntttttttttttttttttttttttttttttt

SEQ ID NO: 1331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnacgtgtagnntttttttttttttttttttttttttttttt

SEQ ID NO: 1332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnactacaggnntttttttttttttttttttttttttttttt

SEQ ID NO: 1333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntacaggtcnntttttttttttttttttttttttttttttt

SEQ ID NO: 1334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnctcacatgnntttttttttttttttttttttttttttttt

SEQ ID NO: 1335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnactaggagnntttttttttttttttttttttttttttttt

SEQ ID NO: 1336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnccatagganntttttttttttttttttttttttttttttt

SEQ ID NO: 1337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnggagaatcnntttttttttttttttttttttttttttttt

SEQ ID NO: 1338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngccaagaanntttttttttttttttttttttttttttttt

SEQ ID NO: 1339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnaaggcaagnntttttttttttttttttttttttttttttt

SEQ ID NO: 1340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnaatgtcgcnntttttttttttttttttttttttttttttt

SEQ ID NO: 1341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnatggaaccnntttttttttttttttttttttttttttttt

SEQ ID NO: 1342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnagaggcatnntttttttttttttttttttttttttttttt

SEQ ID NO: 1343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntgcatagcnntttttttttttttttttttttttttttttt

SEQ ID NO: 1344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnctaacgganntttttttttttttttttttttttttttttt

SEQ ID NO: 1345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntatcgaggnntttttttttttttttttttttttttttttt

SEQ ID NO: 1346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncatagcctnntttttttttttttttttttttttttttttt

SEQ ID NO: 1347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnatcgagacnntttttttttttttttttttttttttttttt

SEQ ID NO: 1348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnggaagagtnntttttttttttttttttttttttttttttt

SEQ ID NO: 1349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnccaagtagnntttttttttttttttttttttttttttttt

SEQ ID NO: 1350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnctgaacagnntttttttttttttttttttttttttttttt

SEQ ID NO: 1351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngtaggttcnntttttttttttttttttttttttttttttt

SEQ ID NO: 1352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngtatggacnntttttttttttttttttttttttttttttt

SEQ ID NO: 1353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntcgcaacanntttttttttttttttttttttttttttttt

SEQ ID NO: 1354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnccgctaatnntttttttttttttttttttttttttttttt

SEQ ID NO: 1355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngattcgcanntttttttttttttttttttttttttttttt

SEQ ID NO: 1356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncgatggaanntttttttttttttttttttttttttttttt

SEQ ID NO: 1357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnagcaagganntttttttttttttttttttttttttttttt

SEQ ID NO: 1358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncgtagcaanntttttttttttttttttttttttttttttt

SEQ ID NO: 1359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntggcagtanntttttttttttttttttttttttttttttt

SEQ ID NO: 1360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncggtagttnntttttttttttttttttttttttttttttt

SEQ ID NO: 1361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntgacttcgnntttttttttttttttttttttttttttttt

SEQ ID NO: 1362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngagtgcaanntttttttttttttttttttttttttttttt

SEQ ID NO: 1363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnacggtaacnntttttttttttttttttttttttttttttt

SEQ ID NO: 1364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnaagtggtgnntttttttttttttttttttttttttttttt

SEQ ID NO: 1365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnggagacaanntttttttttttttttttttttttttttttt

SEQ ID NO: 1366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntcaaggacnntttttttttttttttttttttttttttttt

SEQ ID NO: 1367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnaagagagcnntttttttttttttttttttttttttttttt

SEQ ID NO: 1368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncgagagatnntttttttttttttttttttttttttttttt

SEQ ID NO: 1369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnacagatggnntttttttttttttttttttttttttttttt

SEQ ID NO: 1370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnaggagtcanntttttttttttttttttttttttttttttt

SEQ ID NO: 1371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncgtgttacnntttttttttttttttttttttttttttttt

SEQ ID NO: 1372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntagtgtgcnntttttttttttttttttttttttttttttt

SEQ ID NO: 1373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnctcatgacnntttttttttttttttttttttttttttttt

SEQ ID NO: 1374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngtatccagnntttttttttttttttttttttttttttttt

SEQ ID NO: 1375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnacgcctatnntttttttttttttttttttttttttttttt

SEQ ID NO: 1376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnaacgacctnntttttttttttttttttttttttttttttt

SEQ ID NO: 1377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnatcaggctnntttttttttttttttttttttttttttttt

SEQ ID NO: 1378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncaagttcgnntttttttttttttttttttttttttttttt

SEQ ID NO: 1379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntagccaganntttttttttttttttttttttttttttttt

SEQ ID NO: 1380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncaatcacgnntttttttttttttttttttttttttttttt

SEQ ID NO: 1381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnngcaacaagnntttttttttttttttttttttttttttttt

SEQ ID NO: 1382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncacgacaanntttttttttttttttttttttttttttttt

SEQ ID NO: 1383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntacggaganntttttttttttttttttttttttttttttt

SEQ ID NO: 1384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncgacaaganntttttttttttttttttttttttttttttt

SEQ ID NO: 1385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncgaagtganntttttttttttttttttttttttttttttt

SEQ ID NO: 1386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnagctggtanntttttttttttttttttttttttttttttt

SEQ ID NO: 1387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnaactaggcnntttttttttttttttttttttttttttttt

SEQ ID NO: 1388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncagcaagtnntttttttttttttttttttttttttttttt

SEQ ID NO: 1389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnacgaggtanntttttttttttttttttttttttttttttt

SEQ ID NO: 1390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncatcttccnntttttttttttttttttttttttttttttt

SEQ ID NO: 1391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncctgaatcnntttttttttttttttttttttttttttttt

SEQ ID NO: 1392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnntgcagactnntttttttttttttttttttttttttttttt

SEQ ID NO: 1393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnagatgtggnntttttttttttttttttttttttttttttt

SEQ ID NO: 1394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnagttcgacnntttttttttttttttttttttttttttttt

SEQ ID NO: 1395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnnacaacctcnntttttttttttttttttttttttttttttt

SEQ ID NO: 1396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncatggtagnntttttttttttttttttttttttttttttt

SEQ ID NO: 1397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncgtatctcnntttttttttttttttttttttttttttttt

SEQ ID NO: 1398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncctagttcnntttttttttttttttttttttttttttttt

SEQ ID NO: 1399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtccgatnncaagagtcnntttttttttttttttttttttttttttttt

SEQ ID NO: 1400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnaatcggcanntttttttttttttttttttttttttttttt

SEQ ID NO: 1401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntacggcatnntttttttttttttttttttttttttttttt

SEQ ID NO: 1402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnttggatcgnntttttttttttttttttttttttttttttt

SEQ ID NO: 1403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntggaacganntttttttttttttttttttttttttttttt

SEQ ID NO: 1404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnggcaatcanntttttttttttttttttttttttttttttt

SEQ ID NO: 1405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngaatccganntttttttttttttttttttttttttttttt

SEQ ID NO: 1406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnttacggtgnntttttttttttttttttttttttttttttt

SEQ ID NO: 1407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncatatcggnntttttttttttttttttttttttttttttt

SEQ ID NO: 1408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncttcggtanntttttttttttttttttttttttttttttt

SEQ ID NO: 1409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntcctaacgnntttttttttttttttttttttttttttttt

SEQ ID NO: 1410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngtaagccanntttttttttttttttttttttttttttttt

SEQ ID NO: 1411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntaaggtggnntttttttttttttttttttttttttttttt

SEQ ID NO: 1412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnggtaagctnntttttttttttttttttttttttttttttt

SEQ ID NO: 1413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntgtgtcganntttttttttttttttttttttttttttttt

SEQ ID NO: 1414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngagcatganntttttttttttttttttttttttttttttt

SEQ ID NO: 1415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntcgaagtcnntttttttttttttttttttttttttttttt

SEQ ID NO: 1416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnggtgaacanntttttttttttttttttttttttttttttt

SEQ ID NO: 1417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnacatgcacnntttttttttttttttttttttttttttttt

SEQ ID NO: 1418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnccaacagtnntttttttttttttttttttttttttttttt

SEQ ID NO: 1419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnagaacagcnntttttttttttttttttttttttttttttt

SEQ ID NO: 1420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngaacacgtnntttttttttttttttttttttttttttttt

SEQ ID NO: 1421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnggtcttcanntttttttttttttttttttttttttttttt

SEQ ID NO: 1422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnaggttcagnntttttttttttttttttttttttttttttt

SEQ ID NO: 1423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnctagagcanntttttttttttttttttttttttttttttt

SEQ ID NO: 1424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncttctagcnntttttttttttttttttttttttttttttt

SEQ ID NO: 1425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngagtaacgnntttttttttttttttttttttttttttttt

SEQ ID NO: 1426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnctaagaggnntttttttttttttttttttttttttttttt

SEQ ID NO: 1427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnacgtgtagnntttttttttttttttttttttttttttttt

SEQ ID NO: 1428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnactacaggnntttttttttttttttttttttttttttttt

SEQ ID NO: 1429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntacaggtcnntttttttttttttttttttttttttttttt

SEQ ID NO: 1430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnctcacatgnntttttttttttttttttttttttttttttt

SEQ ID NO: 1431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnactaggagnntttttttttttttttttttttttttttttt

SEQ ID NO: 1432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnccatagganntttttttttttttttttttttttttttttt

SEQ ID NO: 1433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnggagaatcnntttttttttttttttttttttttttttttt

SEQ ID NO: 1434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngccaagaanntttttttttttttttttttttttttttttt

SEQ ID NO: 1435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnaaggcaagnntttttttttttttttttttttttttttttt

SEQ ID NO: 1436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnaatgtcgcnntttttttttttttttttttttttttttttt

SEQ ID NO: 1437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnatggaaccnntttttttttttttttttttttttttttttt

SEQ ID NO: 1438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnagaggcatnntttttttttttttttttttttttttttttt

SEQ ID NO: 1439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntgcatagcnntttttttttttttttttttttttttttttt

SEQ ID NO: 1440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnctaacgganntttttttttttttttttttttttttttttt

SEQ ID NO: 1441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntatcgaggnntttttttttttttttttttttttttttttt

SEQ ID NO: 1442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncatagcctnntttttttttttttttttttttttttttttt

SEQ ID NO: 1443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnatcgagacnntttttttttttttttttttttttttttttt

SEQ ID NO: 1444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnggaagagtnntttttttttttttttttttttttttttttt

SEQ ID NO: 1445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnccaagtagnntttttttttttttttttttttttttttttt

SEQ ID NO: 1446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnctgaacagnntttttttttttttttttttttttttttttt

SEQ ID NO: 1447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngtaggttcnntttttttttttttttttttttttttttttt

SEQ ID NO: 1448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngtatggacnntttttttttttttttttttttttttttttt

SEQ ID NO: 1449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntcgcaacanntttttttttttttttttttttttttttttt

SEQ ID NO: 1450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnccgctaatnntttttttttttttttttttttttttttttt

SEQ ID NO: 1451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngattcgcanntttttttttttttttttttttttttttttt

SEQ ID NO: 1452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncgatggaanntttttttttttttttttttttttttttttt

SEQ ID NO: 1453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnagcaagganntttttttttttttttttttttttttttttt

SEQ ID NO: 1454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncgtagcaanntttttttttttttttttttttttttttttt

SEQ ID NO: 1455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntggcagtanntttttttttttttttttttttttttttttt

SEQ ID NO: 1456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncggtagttnntttttttttttttttttttttttttttttt

SEQ ID NO: 1457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntgacttcgnntttttttttttttttttttttttttttttt

SEQ ID NO: 1458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngagtgcaanntttttttttttttttttttttttttttttt

SEQ ID NO: 1459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnacggtaacnntttttttttttttttttttttttttttttt

SEQ ID NO: 1460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnaagtggtgnntttttttttttttttttttttttttttttt

SEQ ID NO: 1461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnggagacaanntttttttttttttttttttttttttttttt

SEQ ID NO: 1462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntcaaggacnntttttttttttttttttttttttttttttt

SEQ ID NO: 1463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnaagagagcnntttttttttttttttttttttttttttttt

SEQ ID NO: 1464 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncgagagatnntttttttttttttttttttttttttttttt

SEQ ID NO: 1465 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnacagatggnntttttttttttttttttttttttttttttt

SEQ ID NO: 1466 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnaggagtcanntttttttttttttttttttttttttttttt

SEQ ID NO: 1467 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncgtgttacnntttttttttttttttttttttttttttttt

SEQ ID NO: 1468 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntagtgtgcnntttttttttttttttttttttttttttttt

SEQ ID NO: 1469 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnctcatgacnntttttttttttttttttttttttttttttt

SEQ ID NO: 1470 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngtatccagnntttttttttttttttttttttttttttttt

SEQ ID NO: 1471 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnacgcctatnntttttttttttttttttttttttttttttt

SEQ ID NO: 1472 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnaacgacctnntttttttttttttttttttttttttttttt

SEQ ID NO: 1473 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnatcaggctnntttttttttttttttttttttttttttttt

SEQ ID NO: 1474 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncaagttcgnntttttttttttttttttttttttttttttt

SEQ ID NO: 1475 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntagccaganntttttttttttttttttttttttttttttt

SEQ ID NO: 1476 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncaatcacgnntttttttttttttttttttttttttttttt

SEQ ID NO: 1477 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnngcaacaagnntttttttttttttttttttttttttttttt

SEQ ID NO: 1478 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncacgacaanntttttttttttttttttttttttttttttt

SEQ ID NO: 1479 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntacggaganntttttttttttttttttttttttttttttt

SEQ ID NO: 1480 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncgacaaganntttttttttttttttttttttttttttttt

SEQ ID NO: 1481 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncgaagtganntttttttttttttttttttttttttttttt

SEQ ID NO: 1482 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnagctggtanntttttttttttttttttttttttttttttt

SEQ ID NO: 1483 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnaactaggcnntttttttttttttttttttttttttttttt

SEQ ID NO: 1484 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncagcaagtnntttttttttttttttttttttttttttttt

SEQ ID NO: 1485 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnacgaggtanntttttttttttttttttttttttttttttt

SEQ ID NO: 1486 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncatcttccnntttttttttttttttttttttttttttttt

SEQ ID NO: 1487 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncctgaatcnntttttttttttttttttttttttttttttt

SEQ ID NO: 1488 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnntgcagactnntttttttttttttttttttttttttttttt

SEQ ID NO: 1489 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnagatgtggnntttttttttttttttttttttttttttttt

SEQ ID NO: 1490 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnagttcgacnntttttttttttttttttttttttttttttt

SEQ ID NO: 1491 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnnacaacctcnntttttttttttttttttttttttttttttt

SEQ ID NO: 1492 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncatggtagnntttttttttttttttttttttttttttttt

SEQ ID NO: 1493 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncgtatctcnntttttttttttttttttttttttttttttt

SEQ ID NO: 1494 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncctagttcnntttttttttttttttttttttttttttttt

SEQ ID NO: 1495 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngctattcgnncaagagtcnntttttttttttttttttttttttttttttt

SEQ ID NO: 1496 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnaatcggcanntttttttttttttttttttttttttttttt

SEQ ID NO: 1497 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntacggcatnntttttttttttttttttttttttttttttt

SEQ ID NO: 1498 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnttggatcgnntttttttttttttttttttttttttttttt

SEQ ID NO: 1499 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntggaacganntttttttttttttttttttttttttttttt

SEQ ID NO: 1500 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnggcaatcanntttttttttttttttttttttttttttttt

SEQ ID NO: 1501 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngaatccganntttttttttttttttttttttttttttttt

SEQ ID NO: 1502 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnttacggtgnntttttttttttttttttttttttttttttt

SEQ ID NO: 1503 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncatatcggnntttttttttttttttttttttttttttttt

SEQ ID NO: 1504 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncttcggtanntttttttttttttttttttttttttttttt

SEQ ID NO: 1505 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntcctaacgnntttttttttttttttttttttttttttttt

SEQ ID NO: 1506 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngtaagccanntttttttttttttttttttttttttttttt

SEQ ID NO: 1507 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntaaggtggnntttttttttttttttttttttttttttttt

SEQ ID NO: 1508 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnggtaagctnntttttttttttttttttttttttttttttt

SEQ ID NO: 1509 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntgtgtcganntttttttttttttttttttttttttttttt

SEQ ID NO: 1510 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngagcatganntttttttttttttttttttttttttttttt

SEQ ID NO: 1511 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntcgaagtcnntttttttttttttttttttttttttttttt

SEQ ID NO: 1512 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnggtgaacanntttttttttttttttttttttttttttttt

SEQ ID NO: 1513 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnacatgcacnntttttttttttttttttttttttttttttt

SEQ ID NO: 1514 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnccaacagtnntttttttttttttttttttttttttttttt

SEQ ID NO: 1515 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnagaacagcnntttttttttttttttttttttttttttttt

SEQ ID NO: 1516 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngaacacgtnntttttttttttttttttttttttttttttt

SEQ ID NO: 1517 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnggtcttcanntttttttttttttttttttttttttttttt

SEQ ID NO: 1518 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnaggttcagnntttttttttttttttttttttttttttttt

SEQ ID NO: 1519 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnctagagcanntttttttttttttttttttttttttttttt

SEQ ID NO: 1520 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncttctagcnntttttttttttttttttttttttttttttt

SEQ ID NO: 1521 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngagtaacgnntttttttttttttttttttttttttttttt

SEQ ID NO: 1522 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnctaagaggnntttttttttttttttttttttttttttttt

SEQ ID NO: 1523 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnacgtgtagnntttttttttttttttttttttttttttttt

SEQ ID NO: 1524 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnactacaggnntttttttttttttttttttttttttttttt

SEQ ID NO: 1525 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntacaggtcnntttttttttttttttttttttttttttttt

SEQ ID NO: 1526 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnctcacatgnntttttttttttttttttttttttttttttt

SEQ ID NO: 1527 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnactaggagnntttttttttttttttttttttttttttttt

SEQ ID NO: 1528 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnccatagganntttttttttttttttttttttttttttttt

SEQ ID NO: 1529 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnggagaatcnntttttttttttttttttttttttttttttt

SEQ ID NO: 1530 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngccaagaanntttttttttttttttttttttttttttttt

SEQ ID NO: 1531 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnaaggcaagnntttttttttttttttttttttttttttttt

SEQ ID NO: 1532 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnaatgtcgcnntttttttttttttttttttttttttttttt

SEQ ID NO: 1533 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnatggaaccnntttttttttttttttttttttttttttttt

SEQ ID NO: 1534 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnagaggcatnntttttttttttttttttttttttttttttt

SEQ ID NO: 1535 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntgcatagcnntttttttttttttttttttttttttttttt

SEQ ID NO: 1536 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnctaacgganntttttttttttttttttttttttttttttt

SEQ ID NO: 1537 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntatcgaggnntttttttttttttttttttttttttttttt

SEQ ID NO: 1538 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncatagcctnntttttttttttttttttttttttttttttt

SEQ ID NO: 1539 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnatcgagacnntttttttttttttttttttttttttttttt

SEQ ID NO: 1540 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnggaagagtnntttttttttttttttttttttttttttttt

SEQ ID NO: 1541 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnccaagtagnntttttttttttttttttttttttttttttt

SEQ ID NO: 1542 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnctgaacagnntttttttttttttttttttttttttttttt

SEQ ID NO: 1543 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngtaggttcnntttttttttttttttttttttttttttttt

SEQ ID NO: 1544 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngtatggacnntttttttttttttttttttttttttttttt

SEQ ID NO: 1545 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntcgcaacanntttttttttttttttttttttttttttttt

SEQ ID NO: 1546 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnccgctaatnntttttttttttttttttttttttttttttt

SEQ ID NO: 1547 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngattcgcanntttttttttttttttttttttttttttttt

SEQ ID NO: 1548 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncgatggaanntttttttttttttttttttttttttttttt

SEQ ID NO: 1549 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnagcaagganntttttttttttttttttttttttttttttt

SEQ ID NO: 1550 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncgtagcaanntttttttttttttttttttttttttttttt

SEQ ID NO: 1551 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntggcagtanntttttttttttttttttttttttttttttt

SEQ ID NO: 1552 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncggtagttnntttttttttttttttttttttttttttttt

SEQ ID NO: 1553 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntgacttcgnntttttttttttttttttttttttttttttt

SEQ ID NO: 1554 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngagtgcaanntttttttttttttttttttttttttttttt

SEQ ID NO: 1555 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnacggtaacnntttttttttttttttttttttttttttttt

SEQ ID NO: 1556 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnaagtggtgnntttttttttttttttttttttttttttttt

SEQ ID NO: 1557 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnggagacaanntttttttttttttttttttttttttttttt

SEQ ID NO: 1558 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntcaaggacnntttttttttttttttttttttttttttttt

SEQ ID NO: 1559 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnaagagagcnntttttttttttttttttttttttttttttt

SEQ ID NO: 1560 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncgagagatnntttttttttttttttttttttttttttttt

SEQ ID NO: 1561 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnacagatggnntttttttttttttttttttttttttttttt

SEQ ID NO: 1562 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnaggagtcanntttttttttttttttttttttttttttttt

SEQ ID NO: 1563 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncgtgttacnntttttttttttttttttttttttttttttt

SEQ ID NO: 1564 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntagtgtgcnntttttttttttttttttttttttttttttt

SEQ ID NO: 1565 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnctcatgacnntttttttttttttttttttttttttttttt

SEQ ID NO: 1566 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngtatccagnntttttttttttttttttttttttttttttt

SEQ ID NO: 1567 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnacgcctatnntttttttttttttttttttttttttttttt

SEQ ID NO: 1568 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnaacgacctnntttttttttttttttttttttttttttttt

SEQ ID NO: 1569 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnatcaggctnntttttttttttttttttttttttttttttt

SEQ ID NO: 1570 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncaagttcgnntttttttttttttttttttttttttttttt

SEQ ID NO: 1571 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntagccaganntttttttttttttttttttttttttttttt

SEQ ID NO: 1572 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncaatcacgnntttttttttttttttttttttttttttttt

SEQ ID NO: 1573 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnngcaacaagnntttttttttttttttttttttttttttttt

SEQ ID NO: 1574 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncacgacaanntttttttttttttttttttttttttttttt

SEQ ID NO: 1575 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntacggaganntttttttttttttttttttttttttttttt

SEQ ID NO: 1576 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncgacaaganntttttttttttttttttttttttttttttt

SEQ ID NO: 1577 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncgaagtganntttttttttttttttttttttttttttttt

SEQ ID NO: 1578 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnagctggtanntttttttttttttttttttttttttttttt

SEQ ID NO: 1579 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnaactaggcnntttttttttttttttttttttttttttttt

SEQ ID NO: 1580 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncagcaagtnntttttttttttttttttttttttttttttt

SEQ ID NO: 1581 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnacgaggtanntttttttttttttttttttttttttttttt

SEQ ID NO: 1582 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncatcttccnntttttttttttttttttttttttttttttt

SEQ ID NO: 1583 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncctgaatcnntttttttttttttttttttttttttttttt

SEQ ID NO: 1584 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnntgcagactnntttttttttttttttttttttttttttttt

SEQ ID NO: 1585 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnagatgtggnntttttttttttttttttttttttttttttt

SEQ ID NO: 1586 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnagttcgacnntttttttttttttttttttttttttttttt

SEQ ID NO: 1587 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnnacaacctcnntttttttttttttttttttttttttttttt

SEQ ID NO: 1588 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncatggtagnntttttttttttttttttttttttttttttt

SEQ ID NO: 1589 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncgtatctcnntttttttttttttttttttttttttttttt

SEQ ID NO: 1590 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncctagttcnntttttttttttttttttttttttttttttt

SEQ ID NO: 1591 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagcctaacnncaagagtcnntttttttttttttttttttttttttttttt

SEQ ID NO: 1592 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnaatcggcanntttttttttttttttttttttttttttttt

SEQ ID NO: 1593 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntacggcatnntttttttttttttttttttttttttttttt

SEQ ID NO: 1594 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnttggatcgnntttttttttttttttttttttttttttttt

SEQ ID NO: 1595 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntggaacganntttttttttttttttttttttttttttttt

SEQ ID NO: 1596 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnggcaatcanntttttttttttttttttttttttttttttt

SEQ ID NO: 1597 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngaatccganntttttttttttttttttttttttttttttt

SEQ ID NO: 1598 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnttacggtgnntttttttttttttttttttttttttttttt

SEQ ID NO: 1599 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncatatcggnntttttttttttttttttttttttttttttt

SEQ ID NO: 1600 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncttcggtanntttttttttttttttttttttttttttttt

SEQ ID NO: 1601 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntcctaacgnntttttttttttttttttttttttttttttt

SEQ ID NO: 1602 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngtaagccanntttttttttttttttttttttttttttttt

SEQ ID NO: 1603 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntaaggtggnntttttttttttttttttttttttttttttt

SEQ ID NO: 1604 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnggtaagctnntttttttttttttttttttttttttttttt

SEQ ID NO: 1605 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntgtgtcganntttttttttttttttttttttttttttttt

SEQ ID NO: 1606 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngagcatganntttttttttttttttttttttttttttttt

SEQ ID NO: 1607 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntcgaagtcnntttttttttttttttttttttttttttttt

SEQ ID NO: 1608 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnggtgaacanntttttttttttttttttttttttttttttt

SEQ ID NO: 1609 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnacatgcacnntttttttttttttttttttttttttttttt

SEQ ID NO: 1610 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnccaacagtnntttttttttttttttttttttttttttttt

SEQ ID NO: 1611 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnagaacagcnntttttttttttttttttttttttttttttt

SEQ ID NO: 1612 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngaacacgtnntttttttttttttttttttttttttttttt

SEQ ID NO: 1613 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnggtcttcanntttttttttttttttttttttttttttttt

SEQ ID NO: 1614 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnaggttcagnntttttttttttttttttttttttttttttt

SEQ ID NO: 1615 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnctagagcanntttttttttttttttttttttttttttttt

SEQ ID NO: 1616 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncttctagcnntttttttttttttttttttttttttttttt

SEQ ID NO: 1617 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngagtaacgnntttttttttttttttttttttttttttttt

SEQ ID NO: 1618 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnctaagaggnntttttttttttttttttttttttttttttt

SEQ ID NO: 1619 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnacgtgtagnntttttttttttttttttttttttttttttt

SEQ ID NO: 1620 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnactacaggnntttttttttttttttttttttttttttttt

SEQ ID NO: 1621 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntacaggtcnntttttttttttttttttttttttttttttt

SEQ ID NO: 1622 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnctcacatgnntttttttttttttttttttttttttttttt

SEQ ID NO: 1623 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnactaggagnntttttttttttttttttttttttttttttt

SEQ ID NO: 1624 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnccatagganntttttttttttttttttttttttttttttt

SEQ ID NO: 1625 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnggagaatcnntttttttttttttttttttttttttttttt

SEQ ID NO: 1626 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngccaagaanntttttttttttttttttttttttttttttt

SEQ ID NO: 1627 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnaaggcaagnntttttttttttttttttttttttttttttt

SEQ ID NO: 1628 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnaatgtcgcnntttttttttttttttttttttttttttttt

SEQ ID NO: 1629 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnatggaaccnntttttttttttttttttttttttttttttt

SEQ ID NO: 1630 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnagaggcatnntttttttttttttttttttttttttttttt

SEQ ID NO: 1631 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntgcatagcnntttttttttttttttttttttttttttttt

SEQ ID NO: 1632 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnctaacgganntttttttttttttttttttttttttttttt

SEQ ID NO: 1633 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntatcgaggnntttttttttttttttttttttttttttttt

SEQ ID NO: 1634 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncatagcctnntttttttttttttttttttttttttttttt

SEQ ID NO: 1635 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnatcgagacnntttttttttttttttttttttttttttttt

SEQ ID NO: 1636 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnggaagagtnntttttttttttttttttttttttttttttt

SEQ ID NO: 1637 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnccaagtagnntttttttttttttttttttttttttttttt

SEQ ID NO: 1638 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnctgaacagnntttttttttttttttttttttttttttttt

SEQ ID NO: 1639 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngtaggttcnntttttttttttttttttttttttttttttt

SEQ ID NO: 1640 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngtatggacnntttttttttttttttttttttttttttttt

SEQ ID NO: 1641 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntcgcaacanntttttttttttttttttttttttttttttt

SEQ ID NO: 1642 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnccgctaatnntttttttttttttttttttttttttttttt

SEQ ID NO: 1643 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngattcgcanntttttttttttttttttttttttttttttt

SEQ ID NO: 1644 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncgatggaanntttttttttttttttttttttttttttttt

SEQ ID NO: 1645 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnagcaagganntttttttttttttttttttttttttttttt

SEQ ID NO: 1646 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncgtagcaanntttttttttttttttttttttttttttttt

SEQ ID NO: 1647 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntggcagtanntttttttttttttttttttttttttttttt

SEQ ID NO: 1648 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncggtagttnntttttttttttttttttttttttttttttt

SEQ ID NO: 1649 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntgacttcgnntttttttttttttttttttttttttttttt

SEQ ID NO: 1650 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngagtgcaanntttttttttttttttttttttttttttttt

SEQ ID NO: 1651 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnacggtaacnntttttttttttttttttttttttttttttt

SEQ ID NO: 1652 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnaagtggtgnntttttttttttttttttttttttttttttt

SEQ ID NO: 1653 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnggagacaanntttttttttttttttttttttttttttttt

SEQ ID NO: 1654 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntcaaggacnntttttttttttttttttttttttttttttt

SEQ ID NO: 1655 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnaagagagcnntttttttttttttttttttttttttttttt

SEQ ID NO: 1656 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncgagagatnntttttttttttttttttttttttttttttt

SEQ ID NO: 1657 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnacagatggnntttttttttttttttttttttttttttttt

SEQ ID NO: 1658 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnaggagtcanntttttttttttttttttttttttttttttt

SEQ ID NO: 1659 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncgtgttacnntttttttttttttttttttttttttttttt

SEQ ID NO: 1660 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntagtgtgcnntttttttttttttttttttttttttttttt

SEQ ID NO: 1661 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnctcatgacnntttttttttttttttttttttttttttttt

SEQ ID NO: 1662 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngtatccagnntttttttttttttttttttttttttttttt

SEQ ID NO: 1663 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnacgcctatnntttttttttttttttttttttttttttttt

SEQ ID NO: 1664 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnaacgacctnntttttttttttttttttttttttttttttt

SEQ ID NO: 1665 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnatcaggctnntttttttttttttttttttttttttttttt

SEQ ID NO: 1666 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncaagttcgnntttttttttttttttttttttttttttttt

SEQ ID NO: 1667 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntagccaganntttttttttttttttttttttttttttttt

SEQ ID NO: 1668 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncaatcacgnntttttttttttttttttttttttttttttt

SEQ ID NO: 1669 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnngcaacaagnntttttttttttttttttttttttttttttt

SEQ ID NO: 1670 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncacgacaanntttttttttttttttttttttttttttttt

SEQ ID NO: 1671 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntacggaganntttttttttttttttttttttttttttttt

SEQ ID NO: 1672 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncgacaaganntttttttttttttttttttttttttttttt

SEQ ID NO: 1673 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncgaagtganntttttttttttttttttttttttttttttt

SEQ ID NO: 1674 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnagctggtanntttttttttttttttttttttttttttttt

SEQ ID NO: 1675 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnaactaggcnntttttttttttttttttttttttttttttt

SEQ ID NO: 1676 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncagcaagtnntttttttttttttttttttttttttttttt

SEQ ID NO: 1677 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnacgaggtanntttttttttttttttttttttttttttttt

SEQ ID NO: 1678 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncatcttccnntttttttttttttttttttttttttttttt

SEQ ID NO: 1679 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncctgaatcnntttttttttttttttttttttttttttttt

SEQ ID NO: 1680 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnntgcagactnntttttttttttttttttttttttttttttt

SEQ ID NO: 1681 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnagatgtggnntttttttttttttttttttttttttttttt

SEQ ID NO: 1682 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnagttcgacnntttttttttttttttttttttttttttttt

SEQ ID NO: 1683 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnnacaacctcnntttttttttttttttttttttttttttttt

SEQ ID NO: 1684 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncatggtagnntttttttttttttttttttttttttttttt

SEQ ID NO: 1685 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncgtatctcnntttttttttttttttttttttttttttttt

SEQ ID NO: 1686 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncctagttcnntttttttttttttttttttttttttttttt

SEQ ID NO: 1687 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngcctatctnncaagagtcnntttttttttttttttttttttttttttttt

SEQ ID NO: 1688 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannaatcggcanntttttttttttttttttttttttttttttt

SEQ ID NO: 1689 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntacggcatnntttttttttttttttttttttttttttttt

SEQ ID NO: 1690 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannttggatcgnntttttttttttttttttttttttttttttt

SEQ ID NO: 1691 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntggaacganntttttttttttttttttttttttttttttt

SEQ ID NO: 1692 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannggcaatcanntttttttttttttttttttttttttttttt

SEQ ID NO: 1693 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngaatccganntttttttttttttttttttttttttttttt

SEQ ID NO: 1694 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannttacggtgnntttttttttttttttttttttttttttttt

SEQ ID NO: 1695 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncatatcggnntttttttttttttttttttttttttttttt

SEQ ID NO: 1696 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncttcggtanntttttttttttttttttttttttttttttt

SEQ ID NO: 1697 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntcctaacgnntttttttttttttttttttttttttttttt

SEQ ID NO: 1698 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngtaagccanntttttttttttttttttttttttttttttt

SEQ ID NO: 1699 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntaaggtggnntttttttttttttttttttttttttttttt

SEQ ID NO: 1700 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannggtaagctnntttttttttttttttttttttttttttttt

SEQ ID NO: 1701 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntgtgtcganntttttttttttttttttttttttttttttt

SEQ ID NO: 1702 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngagcatganntttttttttttttttttttttttttttttt

SEQ ID NO: 1703 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntcgaagtcnntttttttttttttttttttttttttttttt

SEQ ID NO: 1704 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannggtgaacanntttttttttttttttttttttttttttttt

SEQ ID NO: 1705 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannacatgcacnntttttttttttttttttttttttttttttt

SEQ ID NO: 1706 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannccaacagtnntttttttttttttttttttttttttttttt

SEQ ID NO: 1707 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannagaacagcnntttttttttttttttttttttttttttttt

SEQ ID NO: 1708 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngaacacgtnntttttttttttttttttttttttttttttt

SEQ ID NO: 1709 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannggtcttcanntttttttttttttttttttttttttttttt

SEQ ID NO: 1710 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannaggttcagnntttttttttttttttttttttttttttttt

SEQ ID NO: 1711 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannctagagcanntttttttttttttttttttttttttttttt

SEQ ID NO: 1712 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncttctagcnntttttttttttttttttttttttttttttt

SEQ ID NO: 1713 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngagtaacgnntttttttttttttttttttttttttttttt

SEQ ID NO: 1714 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannctaagaggnntttttttttttttttttttttttttttttt

SEQ ID NO: 1715 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannacgtgtagnntttttttttttttttttttttttttttttt

SEQ ID NO: 1716 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannactacaggnntttttttttttttttttttttttttttttt

SEQ ID NO: 1717 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntacaggtcnntttttttttttttttttttttttttttttt

SEQ ID NO: 1718 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannctcacatgnntttttttttttttttttttttttttttttt

SEQ ID NO: 1719 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannactaggagnntttttttttttttttttttttttttttttt

SEQ ID NO: 1720 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannccatagganntttttttttttttttttttttttttttttt

SEQ ID NO: 1721 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannggagaatcnntttttttttttttttttttttttttttttt

SEQ ID NO: 1722 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngccaagaanntttttttttttttttttttttttttttttt

SEQ ID NO: 1723 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannaaggcaagnntttttttttttttttttttttttttttttt

SEQ ID NO: 1724 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannaatgtcgcnntttttttttttttttttttttttttttttt

SEQ ID NO: 1725 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannatggaaccnntttttttttttttttttttttttttttttt

SEQ ID NO: 1726 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannagaggcatnntttttttttttttttttttttttttttttt

SEQ ID NO: 1727 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntgcatagcnntttttttttttttttttttttttttttttt

SEQ ID NO: 1728 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannctaacgganntttttttttttttttttttttttttttttt

SEQ ID NO: 1729 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntatcgaggnntttttttttttttttttttttttttttttt

SEQ ID NO: 1730 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncatagcctnntttttttttttttttttttttttttttttt

SEQ ID NO: 1731 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannatcgagacnntttttttttttttttttttttttttttttt

SEQ ID NO: 1732 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannggaagagtnntttttttttttttttttttttttttttttt

SEQ ID NO: 1733 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannccaagtagnntttttttttttttttttttttttttttttt

SEQ ID NO: 1734 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannctgaacagnntttttttttttttttttttttttttttttt

SEQ ID NO: 1735 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngtaggttcnntttttttttttttttttttttttttttttt

SEQ ID NO: 1736 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngtatggacnntttttttttttttttttttttttttttttt

SEQ ID NO: 1737 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntcgcaacanntttttttttttttttttttttttttttttt

SEQ ID NO: 1738 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannccgctaatnntttttttttttttttttttttttttttttt

SEQ ID NO: 1739 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngattcgcanntttttttttttttttttttttttttttttt

SEQ ID NO: 1740 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncgatggaanntttttttttttttttttttttttttttttt

SEQ ID NO: 1741 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannagcaagganntttttttttttttttttttttttttttttt

SEQ ID NO: 1742 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncgtagcaanntttttttttttttttttttttttttttttt

SEQ ID NO: 1743 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntggcagtanntttttttttttttttttttttttttttttt

SEQ ID NO: 1744 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncggtagttnntttttttttttttttttttttttttttttt

SEQ ID NO: 1745 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntgacttcgnntttttttttttttttttttttttttttttt

SEQ ID NO: 1746 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngagtgcaanntttttttttttttttttttttttttttttt

SEQ ID NO: 1747 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannacggtaacnntttttttttttttttttttttttttttttt

SEQ ID NO: 1748 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannaagtggtgnntttttttttttttttttttttttttttttt

SEQ ID NO: 1749 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannggagacaanntttttttttttttttttttttttttttttt

SEQ ID NO: 1750 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntcaaggacnntttttttttttttttttttttttttttttt

SEQ ID NO: 1751 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannaagagagcnntttttttttttttttttttttttttttttt

SEQ ID NO: 1752 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncgagagatnntttttttttttttttttttttttttttttt

SEQ ID NO: 1753 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannacagatggnntttttttttttttttttttttttttttttt

SEQ ID NO: 1754 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannaggagtcanntttttttttttttttttttttttttttttt

SEQ ID NO: 1755 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncgtgttacnntttttttttttttttttttttttttttttt

SEQ ID NO: 1756 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntagtgtgcnntttttttttttttttttttttttttttttt

SEQ ID NO: 1757 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannctcatgacnntttttttttttttttttttttttttttttt

SEQ ID NO: 1758 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngtatccagnntttttttttttttttttttttttttttttt

SEQ ID NO: 1759 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannacgcctatnntttttttttttttttttttttttttttttt

SEQ ID NO: 1760 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannaacgacctnntttttttttttttttttttttttttttttt

SEQ ID NO: 1761 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannatcaggctnntttttttttttttttttttttttttttttt

SEQ ID NO: 1762 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncaagttcgnntttttttttttttttttttttttttttttt

SEQ ID NO: 1763 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntagccaganntttttttttttttttttttttttttttttt

SEQ ID NO: 1764 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncaatcacgnntttttttttttttttttttttttttttttt

SEQ ID NO: 1765 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganngcaacaagnntttttttttttttttttttttttttttttt

SEQ ID NO: 1766 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncacgacaanntttttttttttttttttttttttttttttt

SEQ ID NO: 1767 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntacggaganntttttttttttttttttttttttttttttt

SEQ ID NO: 1768 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncgacaaganntttttttttttttttttttttttttttttt

SEQ ID NO: 1769 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncgaagtganntttttttttttttttttttttttttttttt

SEQ ID NO: 1770 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannagctggtanntttttttttttttttttttttttttttttt

SEQ ID NO: 1771 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannaactaggcnntttttttttttttttttttttttttttttt

SEQ ID NO: 1772 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncagcaagtnntttttttttttttttttttttttttttttt

SEQ ID NO: 1773 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannacgaggtanntttttttttttttttttttttttttttttt

SEQ ID NO: 1774 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncatcttccnntttttttttttttttttttttttttttttt

SEQ ID NO: 1775 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncctgaatcnntttttttttttttttttttttttttttttt

SEQ ID NO: 1776 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganntgcagactnntttttttttttttttttttttttttttttt

SEQ ID NO: 1777 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannagatgtggnntttttttttttttttttttttttttttttt

SEQ ID NO: 1778 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannagttcgacnntttttttttttttttttttttttttttttt

SEQ ID NO: 1779 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgagannacaacctcnntttttttttttttttttttttttttttttt

SEQ ID NO: 1780 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncatggtagnntttttttttttttttttttttttttttttt

SEQ ID NO: 1781 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncgtatctcnntttttttttttttttttttttttttttttt

SEQ ID NO: 1782 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncctagttcnntttttttttttttttttttttttttttttt

SEQ ID NO: 1783 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtgaganncaagagtcnntttttttttttttttttttttttttttttt

SEQ ID NO: 1784 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnaatcggcanntttttttttttttttttttttttttttttt

SEQ ID NO: 1785 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntacggcatnntttttttttttttttttttttttttttttt

SEQ ID NO: 1786 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnttggatcgnntttttttttttttttttttttttttttttt

SEQ ID NO: 1787 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntggaacganntttttttttttttttttttttttttttttt

SEQ ID NO: 1788 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnggcaatcanntttttttttttttttttttttttttttttt

SEQ ID NO: 1789 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngaatccganntttttttttttttttttttttttttttttt

SEQ ID NO: 1790 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnttacggtgnntttttttttttttttttttttttttttttt

SEQ ID NO: 1791 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncatatcggnntttttttttttttttttttttttttttttt

SEQ ID NO: 1792 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncttcggtanntttttttttttttttttttttttttttttt

SEQ ID NO: 1793 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntcctaacgnntttttttttttttttttttttttttttttt

SEQ ID NO: 1794 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngtaagccanntttttttttttttttttttttttttttttt

SEQ ID NO: 1795 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntaaggtggnntttttttttttttttttttttttttttttt

SEQ ID NO: 1796 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnggtaagctnntttttttttttttttttttttttttttttt

SEQ ID NO: 1797 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntgtgtcganntttttttttttttttttttttttttttttt

SEQ ID NO: 1798 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngagcatganntttttttttttttttttttttttttttttt

SEQ ID NO: 1799 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntcgaagtcnntttttttttttttttttttttttttttttt

SEQ ID NO: 1800 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnggtgaacanntttttttttttttttttttttttttttttt

SEQ ID NO: 1801 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnacatgcacnntttttttttttttttttttttttttttttt

SEQ ID NO: 1802 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnccaacagtnntttttttttttttttttttttttttttttt

SEQ ID NO: 1803 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnagaacagcnntttttttttttttttttttttttttttttt

SEQ ID NO: 1804 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngaacacgtnntttttttttttttttttttttttttttttt

SEQ ID NO: 1805 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnggtcttcanntttttttttttttttttttttttttttttt

SEQ ID NO: 1806 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnaggttcagnntttttttttttttttttttttttttttttt

SEQ ID NO: 1807 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnctagagcanntttttttttttttttttttttttttttttt

SEQ ID NO: 1808 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncttctagcnntttttttttttttttttttttttttttttt

SEQ ID NO: 1809 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngagtaacgnntttttttttttttttttttttttttttttt

SEQ ID NO: 1810 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnctaagaggnntttttttttttttttttttttttttttttt

SEQ ID NO: 1811 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnacgtgtagnntttttttttttttttttttttttttttttt

SEQ ID NO: 1812 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnactacaggnntttttttttttttttttttttttttttttt

SEQ ID NO: 1813 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntacaggtcnntttttttttttttttttttttttttttttt

SEQ ID NO: 1814 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnctcacatgnntttttttttttttttttttttttttttttt

SEQ ID NO: 1815 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnactaggagnntttttttttttttttttttttttttttttt

SEQ ID NO: 1816 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnccatagganntttttttttttttttttttttttttttttt

SEQ ID NO: 1817 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnggagaatcnntttttttttttttttttttttttttttttt

SEQ ID NO: 1818 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngccaagaanntttttttttttttttttttttttttttttt

SEQ ID NO: 1819 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnaaggcaagnntttttttttttttttttttttttttttttt

SEQ ID NO: 1820 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnaatgtcgcnntttttttttttttttttttttttttttttt

SEQ ID NO: 1821 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnatggaaccnntttttttttttttttttttttttttttttt

SEQ ID NO: 1822 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnagaggcatnntttttttttttttttttttttttttttttt

SEQ ID NO: 1823 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntgcatagcnntttttttttttttttttttttttttttttt

SEQ ID NO: 1824 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnctaacgganntttttttttttttttttttttttttttttt

SEQ ID NO: 1825 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntatcgaggnntttttttttttttttttttttttttttttt

SEQ ID NO: 1826 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncatagcctnntttttttttttttttttttttttttttttt

SEQ ID NO: 1827 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnatcgagacnntttttttttttttttttttttttttttttt

SEQ ID NO: 1828 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnggaagagtnntttttttttttttttttttttttttttttt

SEQ ID NO: 1829 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnccaagtagnntttttttttttttttttttttttttttttt

SEQ ID NO: 1830 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnctgaacagnntttttttttttttttttttttttttttttt

SEQ ID NO: 1831 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngtaggttcnntttttttttttttttttttttttttttttt

SEQ ID NO: 1832 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngtatggacnntttttttttttttttttttttttttttttt

SEQ ID NO: 1833 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntcgcaacanntttttttttttttttttttttttttttttt

SEQ ID NO: 1834 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnccgctaatnntttttttttttttttttttttttttttttt

SEQ ID NO: 1835 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngattcgcanntttttttttttttttttttttttttttttt

SEQ ID NO: 1836 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncgatggaanntttttttttttttttttttttttttttttt

SEQ ID NO: 1837 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnagcaagganntttttttttttttttttttttttttttttt

SEQ ID NO: 1838 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncgtagcaanntttttttttttttttttttttttttttttt

SEQ ID NO: 1839 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntggcagtanntttttttttttttttttttttttttttttt

SEQ ID NO: 1840 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncggtagttnntttttttttttttttttttttttttttttt

SEQ ID NO: 1841 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntgacttcgnntttttttttttttttttttttttttttttt

SEQ ID NO: 1842 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngagtgcaanntttttttttttttttttttttttttttttt

SEQ ID NO: 1843 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnacggtaacnntttttttttttttttttttttttttttttt

SEQ ID NO: 1844 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnaagtggtgnntttttttttttttttttttttttttttttt

SEQ ID NO: 1845 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnggagacaanntttttttttttttttttttttttttttttt

SEQ ID NO: 1846 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntcaaggacnntttttttttttttttttttttttttttttt

SEQ ID NO: 1847 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnaagagagcnntttttttttttttttttttttttttttttt

SEQ ID NO: 1848 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncgagagatnntttttttttttttttttttttttttttttt

SEQ ID NO: 1849 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnacagatggnntttttttttttttttttttttttttttttt

SEQ ID NO: 1850 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnaggagtcanntttttttttttttttttttttttttttttt

SEQ ID NO: 1851 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncgtgttacnntttttttttttttttttttttttttttttt

SEQ ID NO: 1852 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntagtgtgcnntttttttttttttttttttttttttttttt

SEQ ID NO: 1853 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnctcatgacnntttttttttttttttttttttttttttttt

SEQ ID NO: 1854 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngtatccagnntttttttttttttttttttttttttttttt

SEQ ID NO: 1855 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnacgcctatnntttttttttttttttttttttttttttttt

SEQ ID NO: 1856 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnaacgacctnntttttttttttttttttttttttttttttt

SEQ ID NO: 1857 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnatcaggctnntttttttttttttttttttttttttttttt

SEQ ID NO: 1858 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncaagttcgnntttttttttttttttttttttttttttttt

SEQ ID NO: 1859 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntagccaganntttttttttttttttttttttttttttttt

SEQ ID NO: 1860 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncaatcacgnntttttttttttttttttttttttttttttt

SEQ ID NO: 1861 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnngcaacaagnntttttttttttttttttttttttttttttt

SEQ ID NO: 1862 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncacgacaanntttttttttttttttttttttttttttttt

SEQ ID NO: 1863 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntacggaganntttttttttttttttttttttttttttttt

SEQ ID NO: 1864 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncgacaaganntttttttttttttttttttttttttttttt

SEQ ID NO: 1865 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncgaagtganntttttttttttttttttttttttttttttt

SEQ ID NO: 1866 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnagctggtanntttttttttttttttttttttttttttttt

SEQ ID NO: 1867 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnaactaggcnntttttttttttttttttttttttttttttt

SEQ ID NO: 1868 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncagcaagtnntttttttttttttttttttttttttttttt

SEQ ID NO: 1869 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnacgaggtanntttttttttttttttttttttttttttttt

SEQ ID NO: 1870 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncatcttccnntttttttttttttttttttttttttttttt

SEQ ID NO: 1871 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncctgaatcnntttttttttttttttttttttttttttttt

SEQ ID NO: 1872 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnntgcagactnntttttttttttttttttttttttttttttt

SEQ ID NO: 1873 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnagatgtggnntttttttttttttttttttttttttttttt

SEQ ID NO: 1874 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnagttcgacnntttttttttttttttttttttttttttttt

SEQ ID NO: 1875 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnnacaacctcnntttttttttttttttttttttttttttttt

SEQ ID NO: 1876 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncatggtagnntttttttttttttttttttttttttttttt

SEQ ID NO: 1877 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncgtatctcnntttttttttttttttttttttttttttttt

SEQ ID NO: 1878 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncctagttcnntttttttttttttttttttttttttttttt

SEQ ID NO: 1879 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgatctagnncaagagtcnntttttttttttttttttttttttttttttt

SEQ ID NO: 1880 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnaatcggcanntttttttttttttttttttttttttttttt

SEQ ID NO: 1881 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntacggcatnntttttttttttttttttttttttttttttt

SEQ ID NO: 1882 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnttggatcgnntttttttttttttttttttttttttttttt

SEQ ID NO: 1883 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntggaacganntttttttttttttttttttttttttttttt

SEQ ID NO: 1884 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnggcaatcanntttttttttttttttttttttttttttttt

SEQ ID NO: 1885 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngaatccganntttttttttttttttttttttttttttttt

SEQ ID NO: 1886 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnttacggtgnntttttttttttttttttttttttttttttt

SEQ ID NO: 1887 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncatatcggnntttttttttttttttttttttttttttttt

SEQ ID NO: 1888 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncttcggtanntttttttttttttttttttttttttttttt

SEQ ID NO: 1889 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntcctaacgnntttttttttttttttttttttttttttttt

SEQ ID NO: 1890 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngtaagccanntttttttttttttttttttttttttttttt

SEQ ID NO: 1891 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntaaggtggnntttttttttttttttttttttttttttttt

SEQ ID NO: 1892 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnggtaagctnntttttttttttttttttttttttttttttt

SEQ ID NO: 1893 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntgtgtcganntttttttttttttttttttttttttttttt

SEQ ID NO: 1894 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngagcatganntttttttttttttttttttttttttttttt

SEQ ID NO: 1895 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntcgaagtcnntttttttttttttttttttttttttttttt

SEQ ID NO: 1896 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnggtgaacanntttttttttttttttttttttttttttttt

SEQ ID NO: 1897 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnacatgcacnntttttttttttttttttttttttttttttt

SEQ ID NO: 1898 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnccaacagtnntttttttttttttttttttttttttttttt

SEQ ID NO: 1899 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnagaacagcnntttttttttttttttttttttttttttttt

SEQ ID NO: 1900 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngaacacgtnntttttttttttttttttttttttttttttt

SEQ ID NO: 1901 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnggtcttcanntttttttttttttttttttttttttttttt

SEQ ID NO: 1902 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnaggttcagnntttttttttttttttttttttttttttttt

SEQ ID NO: 1903 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnctagagcanntttttttttttttttttttttttttttttt

SEQ ID NO: 1904 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncttctagcnntttttttttttttttttttttttttttttt

SEQ ID NO: 1905 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngagtaacgnntttttttttttttttttttttttttttttt

SEQ ID NO: 1906 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnctaagaggnntttttttttttttttttttttttttttttt

SEQ ID NO: 1907 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnacgtgtagnntttttttttttttttttttttttttttttt

SEQ ID NO: 1908 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnactacaggnntttttttttttttttttttttttttttttt

SEQ ID NO: 1909 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntacaggtcnntttttttttttttttttttttttttttttt

SEQ ID NO: 1910 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnctcacatgnntttttttttttttttttttttttttttttt

SEQ ID NO: 1911 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnactaggagnntttttttttttttttttttttttttttttt

SEQ ID NO: 1912 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnccatagganntttttttttttttttttttttttttttttt

SEQ ID NO: 1913 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnggagaatcnntttttttttttttttttttttttttttttt

SEQ ID NO: 1914 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngccaagaanntttttttttttttttttttttttttttttt

SEQ ID NO: 1915 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnaaggcaagnntttttttttttttttttttttttttttttt

SEQ ID NO: 1916 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnaatgtcgcnntttttttttttttttttttttttttttttt

SEQ ID NO: 1917 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnatggaaccnntttttttttttttttttttttttttttttt

SEQ ID NO: 1918 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnagaggcatnntttttttttttttttttttttttttttttt

SEQ ID NO: 1919 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntgcatagcnntttttttttttttttttttttttttttttt

SEQ ID NO: 1920 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnctaacgganntttttttttttttttttttttttttttttt

SEQ ID NO: 1921 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntatcgaggnntttttttttttttttttttttttttttttt

SEQ ID NO: 1922 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncatagcctnntttttttttttttttttttttttttttttt

SEQ ID NO: 1923 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnatcgagacnntttttttttttttttttttttttttttttt

SEQ ID NO: 1924 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnggaagagtnntttttttttttttttttttttttttttttt

SEQ ID NO: 1925 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnccaagtagnntttttttttttttttttttttttttttttt

SEQ ID NO: 1926 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnctgaacagnntttttttttttttttttttttttttttttt

SEQ ID NO: 1927 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngtaggttcnntttttttttttttttttttttttttttttt

SEQ ID NO: 1928 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngtatggacnntttttttttttttttttttttttttttttt

SEQ ID NO: 1929 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntcgcaacanntttttttttttttttttttttttttttttt

SEQ ID NO: 1930 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnccgctaatnntttttttttttttttttttttttttttttt

SEQ ID NO: 1931 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngattcgcanntttttttttttttttttttttttttttttt

SEQ ID NO: 1932 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncgatggaanntttttttttttttttttttttttttttttt

SEQ ID NO: 1933 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnagcaagganntttttttttttttttttttttttttttttt

SEQ ID NO: 1934 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncgtagcaanntttttttttttttttttttttttttttttt

SEQ ID NO: 1935 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntggcagtanntttttttttttttttttttttttttttttt

SEQ ID NO: 1936 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncggtagttnntttttttttttttttttttttttttttttt

SEQ ID NO: 1937 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntgacttcgnntttttttttttttttttttttttttttttt

SEQ ID NO: 1938 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngagtgcaanntttttttttttttttttttttttttttttt

SEQ ID NO: 1939 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnacggtaacnntttttttttttttttttttttttttttttt

SEQ ID NO: 1940 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnaagtggtgnntttttttttttttttttttttttttttttt

SEQ ID NO: 1941 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnggagacaanntttttttttttttttttttttttttttttt

SEQ ID NO: 1942 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntcaaggacnntttttttttttttttttttttttttttttt

SEQ ID NO: 1943 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnaagagagcnntttttttttttttttttttttttttttttt

SEQ ID NO: 1944 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncgagagatnntttttttttttttttttttttttttttttt

SEQ ID NO: 1945 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnacagatggnntttttttttttttttttttttttttttttt

SEQ ID NO: 1946 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnaggagtcanntttttttttttttttttttttttttttttt

SEQ ID NO: 1947 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncgtgttacnntttttttttttttttttttttttttttttt

SEQ ID NO: 1948 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntagtgtgcnntttttttttttttttttttttttttttttt

SEQ ID NO: 1949 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnctcatgacnntttttttttttttttttttttttttttttt

SEQ ID NO: 1950 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngtatccagnntttttttttttttttttttttttttttttt

SEQ ID NO: 1951 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnacgcctatnntttttttttttttttttttttttttttttt

SEQ ID NO: 1952 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnaacgacctnntttttttttttttttttttttttttttttt

SEQ ID NO: 1953 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnatcaggctnntttttttttttttttttttttttttttttt

SEQ ID NO: 1954 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncaagttcgnntttttttttttttttttttttttttttttt

SEQ ID NO: 1955 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntagccaganntttttttttttttttttttttttttttttt

SEQ ID NO: 1956 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncaatcacgnntttttttttttttttttttttttttttttt

SEQ ID NO: 1957 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnngcaacaagnntttttttttttttttttttttttttttttt

SEQ ID NO: 1958 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncacgacaanntttttttttttttttttttttttttttttt

SEQ ID NO: 1959 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntacggaganntttttttttttttttttttttttttttttt

SEQ ID NO: 1960 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncgacaaganntttttttttttttttttttttttttttttt

SEQ ID NO: 1961 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncgaagtganntttttttttttttttttttttttttttttt

SEQ ID NO: 1962 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnagctggtanntttttttttttttttttttttttttttttt

SEQ ID NO: 1963 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnaactaggcnntttttttttttttttttttttttttttttt

SEQ ID NO: 1964 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncagcaagtnntttttttttttttttttttttttttttttt

SEQ ID NO: 1965 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnacgaggtanntttttttttttttttttttttttttttttt

SEQ ID NO: 1966 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncatcttccnntttttttttttttttttttttttttttttt

SEQ ID NO: 1967 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncctgaatcnntttttttttttttttttttttttttttttt

SEQ ID NO: 1968 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnntgcagactnntttttttttttttttttttttttttttttt

SEQ ID NO: 1969 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnagatgtggnntttttttttttttttttttttttttttttt

SEQ ID NO: 1970 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnagttcgacnntttttttttttttttttttttttttttttt

SEQ ID NO: 1971 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnnacaacctcnntttttttttttttttttttttttttttttt

SEQ ID NO: 1972 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncatggtagnntttttttttttttttttttttttttttttt

SEQ ID NO: 1973 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncgtatctcnntttttttttttttttttttttttttttttt

SEQ ID NO: 1974 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncctagttcnntttttttttttttttttttttttttttttt

SEQ ID NO: 1975 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgtatggnncaagagtcnntttttttttttttttttttttttttttttt

SEQ ID NO: 1976 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannaatcggcanntttttttttttttttttttttttttttttt

SEQ ID NO: 1977 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntacggcatnntttttttttttttttttttttttttttttt

SEQ ID NO: 1978 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannttggatcgnntttttttttttttttttttttttttttttt

SEQ ID NO: 1979 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntggaacganntttttttttttttttttttttttttttttt

SEQ ID NO: 1980 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannggcaatcanntttttttttttttttttttttttttttttt

SEQ ID NO: 1981 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngaatccganntttttttttttttttttttttttttttttt

SEQ ID NO: 1982 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannttacggtgnntttttttttttttttttttttttttttttt

SEQ ID NO: 1983 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncatatcggnntttttttttttttttttttttttttttttt

SEQ ID NO: 1984 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncttcggtanntttttttttttttttttttttttttttttt

SEQ ID NO: 1985 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntcctaacgnntttttttttttttttttttttttttttttt

SEQ ID NO: 1986 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngtaagccanntttttttttttttttttttttttttttttt

SEQ ID NO: 1987 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntaaggtggnntttttttttttttttttttttttttttttt

SEQ ID NO: 1988 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannggtaagctnntttttttttttttttttttttttttttttt

SEQ ID NO: 1989 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntgtgtcganntttttttttttttttttttttttttttttt

SEQ ID NO: 1990 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngagcatganntttttttttttttttttttttttttttttt

SEQ ID NO: 1991 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntcgaagtcnntttttttttttttttttttttttttttttt

SEQ ID NO: 1992 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannggtgaacanntttttttttttttttttttttttttttttt

SEQ ID NO: 1993 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannacatgcacnntttttttttttttttttttttttttttttt

SEQ ID NO: 1994 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannccaacagtnntttttttttttttttttttttttttttttt

SEQ ID NO: 1995 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannagaacagcnntttttttttttttttttttttttttttttt

SEQ ID NO: 1996 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngaacacgtnntttttttttttttttttttttttttttttt

SEQ ID NO: 1997 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannggtcttcanntttttttttttttttttttttttttttttt

SEQ ID NO: 1998 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannaggttcagnntttttttttttttttttttttttttttttt

SEQ ID NO: 1999 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannctagagcanntttttttttttttttttttttttttttttt

SEQ ID NO: 2000 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncttctagcnntttttttttttttttttttttttttttttt

SEQ ID NO: 2001 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngagtaacgnntttttttttttttttttttttttttttttt

SEQ ID NO: 2002 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannctaagaggnntttttttttttttttttttttttttttttt

SEQ ID NO: 2003 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannacgtgtagnntttttttttttttttttttttttttttttt

SEQ ID NO: 2004 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannactacaggnntttttttttttttttttttttttttttttt

SEQ ID NO: 2005 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntacaggtcnntttttttttttttttttttttttttttttt

SEQ ID NO: 2006 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannctcacatgnntttttttttttttttttttttttttttttt

SEQ ID NO: 2007 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannactaggagnntttttttttttttttttttttttttttttt

SEQ ID NO: 2008 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannccatagganntttttttttttttttttttttttttttttt

SEQ ID NO: 2009 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannggagaatcnntttttttttttttttttttttttttttttt

SEQ ID NO: 2010 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngccaagaanntttttttttttttttttttttttttttttt

SEQ ID NO: 2011 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannaaggcaagnntttttttttttttttttttttttttttttt

SEQ ID NO: 2012 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannaatgtcgcnntttttttttttttttttttttttttttttt

SEQ ID NO: 2013 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannatggaaccnntttttttttttttttttttttttttttttt

SEQ ID NO: 2014 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannagaggcatnntttttttttttttttttttttttttttttt

SEQ ID NO: 2015 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntgcatagcnntttttttttttttttttttttttttttttt

SEQ ID NO: 2016 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannctaacgganntttttttttttttttttttttttttttttt

SEQ ID NO: 2017 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntatcgaggnntttttttttttttttttttttttttttttt

SEQ ID NO: 2018 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncatagcctnntttttttttttttttttttttttttttttt

SEQ ID NO: 2019 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannatcgagacnntttttttttttttttttttttttttttttt

SEQ ID NO: 2020 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannggaagagtnntttttttttttttttttttttttttttttt

SEQ ID NO: 2021 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannccaagtagnntttttttttttttttttttttttttttttt

SEQ ID NO: 2022 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannctgaacagnntttttttttttttttttttttttttttttt

SEQ ID NO: 2023 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngtaggttcnntttttttttttttttttttttttttttttt

SEQ ID NO: 2024 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngtatggacnntttttttttttttttttttttttttttttt

SEQ ID NO: 2025 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntcgcaacanntttttttttttttttttttttttttttttt

SEQ ID NO: 2026 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannccgctaatnntttttttttttttttttttttttttttttt

SEQ ID NO: 2027 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngattcgcanntttttttttttttttttttttttttttttt

SEQ ID NO: 2028 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncgatggaanntttttttttttttttttttttttttttttt

SEQ ID NO: 2029 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannagcaagganntttttttttttttttttttttttttttttt

SEQ ID NO: 2030 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncgtagcaanntttttttttttttttttttttttttttttt

SEQ ID NO: 2031 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntggcagtanntttttttttttttttttttttttttttttt

SEQ ID NO: 2032 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncggtagttnntttttttttttttttttttttttttttttt

SEQ ID NO: 2033 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntgacttcgnntttttttttttttttttttttttttttttt

SEQ ID NO: 2034 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngagtgcaanntttttttttttttttttttttttttttttt

SEQ ID NO: 2035 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannacggtaacnntttttttttttttttttttttttttttttt

SEQ ID NO: 2036 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannaagtggtgnntttttttttttttttttttttttttttttt

SEQ ID NO: 2037 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannggagacaanntttttttttttttttttttttttttttttt

SEQ ID NO: 2038 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntcaaggacnntttttttttttttttttttttttttttttt

SEQ ID NO: 2039 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannaagagagcnntttttttttttttttttttttttttttttt

SEQ ID NO: 2040 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncgagagatnntttttttttttttttttttttttttttttt

SEQ ID NO: 2041 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannacagatggnntttttttttttttttttttttttttttttt

SEQ ID NO: 2042 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannaggagtcanntttttttttttttttttttttttttttttt

SEQ ID NO: 2043 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncgtgttacnntttttttttttttttttttttttttttttt

SEQ ID NO: 2044 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntagtgtgcnntttttttttttttttttttttttttttttt

SEQ ID NO: 2045 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannctcatgacnntttttttttttttttttttttttttttttt

SEQ ID NO: 2046 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngtatccagnntttttttttttttttttttttttttttttt

SEQ ID NO: 2047 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannacgcctatnntttttttttttttttttttttttttttttt

SEQ ID NO: 2048 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannaacgacctnntttttttttttttttttttttttttttttt

SEQ ID NO: 2049 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannatcaggctnntttttttttttttttttttttttttttttt

SEQ ID NO: 2050 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncaagttcgnntttttttttttttttttttttttttttttt

SEQ ID NO: 2051 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntagccaganntttttttttttttttttttttttttttttt

SEQ ID NO: 2052 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncaatcacgnntttttttttttttttttttttttttttttt

SEQ ID NO: 2053 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanngcaacaagnntttttttttttttttttttttttttttttt

SEQ ID NO: 2054 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncacgacaanntttttttttttttttttttttttttttttt

SEQ ID NO: 2055 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntacggaganntttttttttttttttttttttttttttttt

SEQ ID NO: 2056 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncgacaaganntttttttttttttttttttttttttttttt

SEQ ID NO: 2057 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncgaagtganntttttttttttttttttttttttttttttt

SEQ ID NO: 2058 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannagctggtanntttttttttttttttttttttttttttttt

SEQ ID NO: 2059 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannaactaggcnntttttttttttttttttttttttttttttt

SEQ ID NO: 2060 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncagcaagtnntttttttttttttttttttttttttttttt

SEQ ID NO: 2061 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannacgaggtanntttttttttttttttttttttttttttttt

SEQ ID NO: 2062 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncatcttccnntttttttttttttttttttttttttttttt

SEQ ID NO: 2063 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncctgaatcnntttttttttttttttttttttttttttttt

SEQ ID NO: 2064 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanntgcagactnntttttttttttttttttttttttttttttt

SEQ ID NO: 2065 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannagatgtggnntttttttttttttttttttttttttttttt

SEQ ID NO: 2066 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannagttcgacnntttttttttttttttttttttttttttttt

SEQ ID NO: 2067 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaannacaacctcnntttttttttttttttttttttttttttttt

SEQ ID NO: 2068 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncatggtagnntttttttttttttttttttttttttttttt

SEQ ID NO: 2069 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncgtatctcnntttttttttttttttttttttttttttttt

SEQ ID NO: 2070 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncctagttcnntttttttttttttttttttttttttttttt

SEQ ID NO: 2071 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccggttaanncaagagtcnntttttttttttttttttttttttttttttt

SEQ ID NO: 2072 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnaatcggcanntttttttttttttttttttttttttttttt

SEQ ID NO: 2073 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntacggcatnntttttttttttttttttttttttttttttt

SEQ ID NO: 2074 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnttggatcgnntttttttttttttttttttttttttttttt

SEQ ID NO: 2075 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntggaacganntttttttttttttttttttttttttttttt

SEQ ID NO: 2076 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnggcaatcanntttttttttttttttttttttttttttttt

SEQ ID NO: 2077 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngaatccganntttttttttttttttttttttttttttttt

SEQ ID NO: 2078 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnttacggtgnntttttttttttttttttttttttttttttt

SEQ ID NO: 2079 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncatatcggnntttttttttttttttttttttttttttttt

SEQ ID NO: 2080 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncttcggtanntttttttttttttttttttttttttttttt

SEQ ID NO: 2081 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntcctaacgnntttttttttttttttttttttttttttttt

SEQ ID NO: 2082 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngtaagccanntttttttttttttttttttttttttttttt

SEQ ID NO: 2083 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntaaggtggnntttttttttttttttttttttttttttttt

SEQ ID NO: 2084 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnggtaagctnntttttttttttttttttttttttttttttt

SEQ ID NO: 2085 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntgtgtcganntttttttttttttttttttttttttttttt

SEQ ID NO: 2086 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngagcatganntttttttttttttttttttttttttttttt

SEQ ID NO: 2087 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntcgaagtcnntttttttttttttttttttttttttttttt

SEQ ID NO: 2088 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnggtgaacanntttttttttttttttttttttttttttttt

SEQ ID NO: 2089 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnacatgcacnntttttttttttttttttttttttttttttt

SEQ ID NO: 2090 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnccaacagtnntttttttttttttttttttttttttttttt

SEQ ID NO: 2091 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnagaacagcnntttttttttttttttttttttttttttttt

SEQ ID NO: 2092 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngaacacgtnntttttttttttttttttttttttttttttt

SEQ ID NO: 2093 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnggtcttcanntttttttttttttttttttttttttttttt

SEQ ID NO: 2094 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnaggttcagnntttttttttttttttttttttttttttttt

SEQ ID NO: 2095 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnctagagcanntttttttttttttttttttttttttttttt

SEQ ID NO: 2096 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncttctagcnntttttttttttttttttttttttttttttt

SEQ ID NO: 2097 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngagtaacgnntttttttttttttttttttttttttttttt

SEQ ID NO: 2098 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnctaagaggnntttttttttttttttttttttttttttttt

SEQ ID NO: 2099 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnacgtgtagnntttttttttttttttttttttttttttttt

SEQ ID NO: 2100 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnactacaggnntttttttttttttttttttttttttttttt

SEQ ID NO: 2101 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntacaggtcnntttttttttttttttttttttttttttttt

SEQ ID NO: 2102 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnctcacatgnntttttttttttttttttttttttttttttt

SEQ ID NO: 2103 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnactaggagnntttttttttttttttttttttttttttttt

SEQ ID NO: 2104 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnccatagganntttttttttttttttttttttttttttttt

SEQ ID NO: 2105 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnggagaatcnntttttttttttttttttttttttttttttt

SEQ ID NO: 2106 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngccaagaanntttttttttttttttttttttttttttttt

SEQ ID NO: 2107 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnaaggcaagnntttttttttttttttttttttttttttttt

SEQ ID NO: 2108 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnaatgtcgcnntttttttttttttttttttttttttttttt

SEQ ID NO: 2109 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnatggaaccnntttttttttttttttttttttttttttttt

SEQ ID NO: 2110 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnagaggcatnntttttttttttttttttttttttttttttt

SEQ ID NO: 2111 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntgcatagcnntttttttttttttttttttttttttttttt

SEQ ID NO: 2112 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnctaacgganntttttttttttttttttttttttttttttt

SEQ ID NO: 2113 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntatcgaggnntttttttttttttttttttttttttttttt

SEQ ID NO: 2114 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncatagcctnntttttttttttttttttttttttttttttt

SEQ ID NO: 2115 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnatcgagacnntttttttttttttttttttttttttttttt

SEQ ID NO: 2116 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnggaagagtnntttttttttttttttttttttttttttttt

SEQ ID NO: 2117 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnccaagtagnntttttttttttttttttttttttttttttt

SEQ ID NO: 2118 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnctgaacagnntttttttttttttttttttttttttttttt

SEQ ID NO: 2119 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngtaggttcnntttttttttttttttttttttttttttttt

SEQ ID NO: 2120 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngtatggacnntttttttttttttttttttttttttttttt

SEQ ID NO: 2121 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntcgcaacanntttttttttttttttttttttttttttttt

SEQ ID NO: 2122 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnccgctaatnntttttttttttttttttttttttttttttt

SEQ ID NO: 2123 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngattcgcanntttttttttttttttttttttttttttttt

SEQ ID NO: 2124 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncgatggaanntttttttttttttttttttttttttttttt

SEQ ID NO: 2125 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnagcaagganntttttttttttttttttttttttttttttt

SEQ ID NO: 2126 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncgtagcaanntttttttttttttttttttttttttttttt

SEQ ID NO: 2127 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntggcagtanntttttttttttttttttttttttttttttt

SEQ ID NO: 2128 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncggtagttnntttttttttttttttttttttttttttttt

SEQ ID NO: 2129 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntgacttcgnntttttttttttttttttttttttttttttt

SEQ ID NO: 2130 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngagtgcaanntttttttttttttttttttttttttttttt

SEQ ID NO: 2131 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnacggtaacnntttttttttttttttttttttttttttttt

SEQ ID NO: 2132 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnaagtggtgnntttttttttttttttttttttttttttttt

SEQ ID NO: 2133 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnggagacaanntttttttttttttttttttttttttttttt

SEQ ID NO: 2134 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntcaaggacnntttttttttttttttttttttttttttttt

SEQ ID NO: 2135 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnaagagagcnntttttttttttttttttttttttttttttt

SEQ ID NO: 2136 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncgagagatnntttttttttttttttttttttttttttttt

SEQ ID NO: 2137 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnacagatggnntttttttttttttttttttttttttttttt

SEQ ID NO: 2138 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnaggagtcanntttttttttttttttttttttttttttttt

SEQ ID NO: 2139 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncgtgttacnntttttttttttttttttttttttttttttt

SEQ ID NO: 2140 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntagtgtgcnntttttttttttttttttttttttttttttt

SEQ ID NO: 2141 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnctcatgacnntttttttttttttttttttttttttttttt

SEQ ID NO: 2142 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngtatccagnntttttttttttttttttttttttttttttt

SEQ ID NO: 2143 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnacgcctatnntttttttttttttttttttttttttttttt

SEQ ID NO: 2144 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnaacgacctnntttttttttttttttttttttttttttttt

SEQ ID NO: 2145 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnatcaggctnntttttttttttttttttttttttttttttt

SEQ ID NO: 2146 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncaagttcgnntttttttttttttttttttttttttttttt

SEQ ID NO: 2147 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntagccaganntttttttttttttttttttttttttttttt

SEQ ID NO: 2148 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncaatcacgnntttttttttttttttttttttttttttttt

SEQ ID NO: 2149 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnngcaacaagnntttttttttttttttttttttttttttttt

SEQ ID NO: 2150 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncacgacaanntttttttttttttttttttttttttttttt

SEQ ID NO: 2151 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntacggaganntttttttttttttttttttttttttttttt

SEQ ID NO: 2152 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncgacaaganntttttttttttttttttttttttttttttt

SEQ ID NO: 2153 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncgaagtganntttttttttttttttttttttttttttttt

SEQ ID NO: 2154 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnagctggtanntttttttttttttttttttttttttttttt

SEQ ID NO: 2155 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnaactaggcnntttttttttttttttttttttttttttttt

SEQ ID NO: 2156 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncagcaagtnntttttttttttttttttttttttttttttt

SEQ ID NO: 2157 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnacgaggtanntttttttttttttttttttttttttttttt

SEQ ID NO: 2158 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncatcttccnntttttttttttttttttttttttttttttt

SEQ ID NO: 2159 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncctgaatcnntttttttttttttttttttttttttttttt

SEQ ID NO: 2160 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnntgcagactnntttttttttttttttttttttttttttttt

SEQ ID NO: 2161 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnagatgtggnntttttttttttttttttttttttttttttt

SEQ ID NO: 2162 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnagttcgacnntttttttttttttttttttttttttttttt

SEQ ID NO: 2163 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnnacaacctcnntttttttttttttttttttttttttttttt

SEQ ID NO: 2164 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncatggtagnntttttttttttttttttttttttttttttt

SEQ ID NO: 2165 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncgtatctcnntttttttttttttttttttttttttttttt

SEQ ID NO: 2166 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncctagttcnntttttttttttttttttttttttttttttt

SEQ ID NO: 2167 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttgttcggnncaagagtcnntttttttttttttttttttttttttttttt

SEQ ID NO: 2168 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnaatcggcanntttttttttttttttttttttttttttttt

SEQ ID NO: 2169 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntacggcatnntttttttttttttttttttttttttttttt

SEQ ID NO: 2170 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnttggatcgnntttttttttttttttttttttttttttttt

SEQ ID NO: 2171 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntggaacganntttttttttttttttttttttttttttttt

SEQ ID NO: 2172 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnggcaatcanntttttttttttttttttttttttttttttt

SEQ ID NO: 2173 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngaatccganntttttttttttttttttttttttttttttt

SEQ ID NO: 2174 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnttacggtgnntttttttttttttttttttttttttttttt

SEQ ID NO: 2175 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncatatcggnntttttttttttttttttttttttttttttt

SEQ ID NO: 2176 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncttcggtanntttttttttttttttttttttttttttttt

SEQ ID NO: 2177 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntcctaacgnntttttttttttttttttttttttttttttt

SEQ ID NO: 2178 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngtaagccanntttttttttttttttttttttttttttttt

SEQ ID NO: 2179 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntaaggtggnntttttttttttttttttttttttttttttt

SEQ ID NO: 2180 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnggtaagctnntttttttttttttttttttttttttttttt

SEQ ID NO: 2181 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntgtgtcganntttttttttttttttttttttttttttttt

SEQ ID NO: 2182 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngagcatganntttttttttttttttttttttttttttttt

SEQ ID NO: 2183 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntcgaagtcnntttttttttttttttttttttttttttttt

SEQ ID NO: 2184 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnggtgaacanntttttttttttttttttttttttttttttt

SEQ ID NO: 2185 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnacatgcacnntttttttttttttttttttttttttttttt

SEQ ID NO: 2186 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnccaacagtnntttttttttttttttttttttttttttttt

SEQ ID NO: 2187 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnagaacagcnntttttttttttttttttttttttttttttt

SEQ ID NO: 2188 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngaacacgtnntttttttttttttttttttttttttttttt

SEQ ID NO: 2189 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnggtcttcanntttttttttttttttttttttttttttttt

SEQ ID NO: 2190 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnaggttcagnntttttttttttttttttttttttttttttt

SEQ ID NO: 2191 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnctagagcanntttttttttttttttttttttttttttttt

SEQ ID NO: 2192 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncttctagcnntttttttttttttttttttttttttttttt

SEQ ID NO: 2193 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngagtaacgnntttttttttttttttttttttttttttttt

SEQ ID NO: 2194 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnctaagaggnntttttttttttttttttttttttttttttt

SEQ ID NO: 2195 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnacgtgtagnntttttttttttttttttttttttttttttt

SEQ ID NO: 2196 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnactacaggnntttttttttttttttttttttttttttttt

SEQ ID NO: 2197 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntacaggtcnntttttttttttttttttttttttttttttt

SEQ ID NO: 2198 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnctcacatgnntttttttttttttttttttttttttttttt

SEQ ID NO: 2199 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnactaggagnntttttttttttttttttttttttttttttt

SEQ ID NO: 2200 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnccatagganntttttttttttttttttttttttttttttt

SEQ ID NO: 2201 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnggagaatcnntttttttttttttttttttttttttttttt

SEQ ID NO: 2202 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngccaagaanntttttttttttttttttttttttttttttt

SEQ ID NO: 2203 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnaaggcaagnntttttttttttttttttttttttttttttt

SEQ ID NO: 2204 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnaatgtcgcnntttttttttttttttttttttttttttttt

SEQ ID NO: 2205 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnatggaaccnntttttttttttttttttttttttttttttt

SEQ ID NO: 2206 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnagaggcatnntttttttttttttttttttttttttttttt

SEQ ID NO: 2207 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntgcatagcnntttttttttttttttttttttttttttttt

SEQ ID NO: 2208 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnctaacgganntttttttttttttttttttttttttttttt

SEQ ID NO: 2209 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntatcgaggnntttttttttttttttttttttttttttttt

SEQ ID NO: 2210 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncatagcctnntttttttttttttttttttttttttttttt

SEQ ID NO: 2211 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnatcgagacnntttttttttttttttttttttttttttttt

SEQ ID NO: 2212 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnggaagagtnntttttttttttttttttttttttttttttt

SEQ ID NO: 2213 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnccaagtagnntttttttttttttttttttttttttttttt

SEQ ID NO: 2214 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnctgaacagnntttttttttttttttttttttttttttttt

SEQ ID NO: 2215 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngtaggttcnntttttttttttttttttttttttttttttt

SEQ ID NO: 2216 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngtatggacnntttttttttttttttttttttttttttttt

SEQ ID NO: 2217 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntcgcaacanntttttttttttttttttttttttttttttt

SEQ ID NO: 2218 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnccgctaatnntttttttttttttttttttttttttttttt

SEQ ID NO: 2219 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngattcgcanntttttttttttttttttttttttttttttt

SEQ ID NO: 2220 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncgatggaanntttttttttttttttttttttttttttttt

SEQ ID NO: 2221 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnagcaagganntttttttttttttttttttttttttttttt

SEQ ID NO: 2222 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncgtagcaanntttttttttttttttttttttttttttttt

SEQ ID NO: 2223 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntggcagtanntttttttttttttttttttttttttttttt

SEQ ID NO: 2224 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncggtagttnntttttttttttttttttttttttttttttt

SEQ ID NO: 2225 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntgacttcgnntttttttttttttttttttttttttttttt

SEQ ID NO: 2226 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngagtgcaanntttttttttttttttttttttttttttttt

SEQ ID NO: 2227 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnacggtaacnntttttttttttttttttttttttttttttt

SEQ ID NO: 2228 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnaagtggtgnntttttttttttttttttttttttttttttt

SEQ ID NO: 2229 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnggagacaanntttttttttttttttttttttttttttttt

SEQ ID NO: 2230 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntcaaggacnntttttttttttttttttttttttttttttt

SEQ ID NO: 2231 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnaagagagcnntttttttttttttttttttttttttttttt

SEQ ID NO: 2232 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncgagagatnntttttttttttttttttttttttttttttt

SEQ ID NO: 2233 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnacagatggnntttttttttttttttttttttttttttttt

SEQ ID NO: 2234 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnaggagtcanntttttttttttttttttttttttttttttt

SEQ ID NO: 2235 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncgtgttacnntttttttttttttttttttttttttttttt

SEQ ID NO: 2236 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntagtgtgcnntttttttttttttttttttttttttttttt

SEQ ID NO: 2237 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnctcatgacnntttttttttttttttttttttttttttttt

SEQ ID NO: 2238 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngtatccagnntttttttttttttttttttttttttttttt

SEQ ID NO: 2239 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnacgcctatnntttttttttttttttttttttttttttttt

SEQ ID NO: 2240 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnaacgacctnntttttttttttttttttttttttttttttt

SEQ ID NO: 2241 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnatcaggctnntttttttttttttttttttttttttttttt

SEQ ID NO: 2242 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncaagttcgnntttttttttttttttttttttttttttttt

SEQ ID NO: 2243 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntagccaganntttttttttttttttttttttttttttttt

SEQ ID NO: 2244 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncaatcacgnntttttttttttttttttttttttttttttt

SEQ ID NO: 2245 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnngcaacaagnntttttttttttttttttttttttttttttt

SEQ ID NO: 2246 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncacgacaanntttttttttttttttttttttttttttttt

SEQ ID NO: 2247 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntacggaganntttttttttttttttttttttttttttttt

SEQ ID NO: 2248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncgacaaganntttttttttttttttttttttttttttttt

SEQ ID NO: 2249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncgaagtganntttttttttttttttttttttttttttttt

SEQ ID NO: 2250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnagctggtanntttttttttttttttttttttttttttttt

SEQ ID NO: 2251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnaactaggcnntttttttttttttttttttttttttttttt

SEQ ID NO: 2252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncagcaagtnntttttttttttttttttttttttttttttt

SEQ ID NO: 2253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnacgaggtanntttttttttttttttttttttttttttttt

SEQ ID NO: 2254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncatcttccnntttttttttttttttttttttttttttttt

SEQ ID NO: 2255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncctgaatcnntttttttttttttttttttttttttttttt

SEQ ID NO: 2256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnntgcagactnntttttttttttttttttttttttttttttt

SEQ ID NO: 2257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnagatgtggnntttttttttttttttttttttttttttttt

SEQ ID NO: 2258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnagttcgacnntttttttttttttttttttttttttttttt

SEQ ID NO: 2259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnnacaacctcnntttttttttttttttttttttttttttttt

SEQ ID NO: 2260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncatggtagnntttttttttttttttttttttttttttttt

SEQ ID NO: 2261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncgtatctcnntttttttttttttttttttttttttttttt

SEQ ID NO: 2262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncctagttcnntttttttttttttttttttttttttttttt

SEQ ID NO: 2263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatcttggnncaagagtcnntttttttttttttttttttttttttttttt

SEQ ID NO: 2264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannaatcggcanntttttttttttttttttttttttttttttt

SEQ ID NO: 2265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntacggcatnntttttttttttttttttttttttttttttt

SEQ ID NO: 2266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannttggatcgnntttttttttttttttttttttttttttttt

SEQ ID NO: 2267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntggaacganntttttttttttttttttttttttttttttt

SEQ ID NO: 2268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannggcaatcanntttttttttttttttttttttttttttttt

SEQ ID NO: 2269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngaatccganntttttttttttttttttttttttttttttt

SEQ ID NO: 2270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannttacggtgnntttttttttttttttttttttttttttttt

SEQ ID NO: 2271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncatatcggnntttttttttttttttttttttttttttttt

SEQ ID NO: 2272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncttcggtanntttttttttttttttttttttttttttttt

SEQ ID NO: 2273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntcctaacgnntttttttttttttttttttttttttttttt

SEQ ID NO: 2274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngtaagccanntttttttttttttttttttttttttttttt

SEQ ID NO: 2275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntaaggtggnntttttttttttttttttttttttttttttt

SEQ ID NO: 2276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannggtaagctnntttttttttttttttttttttttttttttt

SEQ ID NO: 2277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntgtgtcganntttttttttttttttttttttttttttttt

SEQ ID NO: 2278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngagcatganntttttttttttttttttttttttttttttt

SEQ ID NO: 2279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntcgaagtcnntttttttttttttttttttttttttttttt

SEQ ID NO: 2280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannggtgaacanntttttttttttttttttttttttttttttt

SEQ ID NO: 2281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannacatgcacnntttttttttttttttttttttttttttttt

SEQ ID NO: 2282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannccaacagtnntttttttttttttttttttttttttttttt

SEQ ID NO: 2283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannagaacagcnntttttttttttttttttttttttttttttt

SEQ ID NO: 2284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngaacacgtnntttttttttttttttttttttttttttttt

SEQ ID NO: 2285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannggtcttcanntttttttttttttttttttttttttttttt

SEQ ID NO: 2286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannaggttcagnntttttttttttttttttttttttttttttt

SEQ ID NO: 2287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannctagagcanntttttttttttttttttttttttttttttt

SEQ ID NO: 2288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncttctagcnntttttttttttttttttttttttttttttt

SEQ ID NO: 2289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngagtaacgnntttttttttttttttttttttttttttttt

SEQ ID NO: 2290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannctaagaggnntttttttttttttttttttttttttttttt

SEQ ID NO: 2291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannacgtgtagnntttttttttttttttttttttttttttttt

SEQ ID NO: 2292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannactacaggnntttttttttttttttttttttttttttttt

SEQ ID NO: 2293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntacaggtcnntttttttttttttttttttttttttttttt

SEQ ID NO: 2294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannctcacatgnntttttttttttttttttttttttttttttt

SEQ ID NO: 2295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannactaggagnntttttttttttttttttttttttttttttt

SEQ ID NO: 2296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannccatagganntttttttttttttttttttttttttttttt

SEQ ID NO: 2297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannggagaatcnntttttttttttttttttttttttttttttt

SEQ ID NO: 2298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngccaagaanntttttttttttttttttttttttttttttt

SEQ ID NO: 2299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannaaggcaagnntttttttttttttttttttttttttttttt

SEQ ID NO: 2300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannaatgtcgcnntttttttttttttttttttttttttttttt

SEQ ID NO: 2301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannatggaaccnntttttttttttttttttttttttttttttt

SEQ ID NO: 2302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannagaggcatnntttttttttttttttttttttttttttttt

SEQ ID NO: 2303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntgcatagcnntttttttttttttttttttttttttttttt

SEQ ID NO: 2304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannctaacgganntttttttttttttttttttttttttttttt

SEQ ID NO: 2305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntatcgaggnntttttttttttttttttttttttttttttt

SEQ ID NO: 2306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncatagcctnntttttttttttttttttttttttttttttt

SEQ ID NO: 2307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannatcgagacnntttttttttttttttttttttttttttttt

SEQ ID NO: 2308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannggaagagtnntttttttttttttttttttttttttttttt

SEQ ID NO: 2309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannccaagtagnntttttttttttttttttttttttttttttt

SEQ ID NO: 2310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannctgaacagnntttttttttttttttttttttttttttttt

SEQ ID NO: 2311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngtaggttcnntttttttttttttttttttttttttttttt

SEQ ID NO: 2312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngtatggacnntttttttttttttttttttttttttttttt

SEQ ID NO: 2313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntcgcaacanntttttttttttttttttttttttttttttt

SEQ ID NO: 2314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannccgctaatnntttttttttttttttttttttttttttttt

SEQ ID NO: 2315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngattcgcanntttttttttttttttttttttttttttttt

SEQ ID NO: 2316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncgatggaanntttttttttttttttttttttttttttttt

SEQ ID NO: 2317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannagcaagganntttttttttttttttttttttttttttttt

SEQ ID NO: 2318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncgtagcaanntttttttttttttttttttttttttttttt

SEQ ID NO: 2319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntggcagtanntttttttttttttttttttttttttttttt

SEQ ID NO: 2320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncggtagttnntttttttttttttttttttttttttttttt

SEQ ID NO: 2321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntgacttcgnntttttttttttttttttttttttttttttt

SEQ ID NO: 2322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngagtgcaanntttttttttttttttttttttttttttttt

SEQ ID NO: 2323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannacggtaacnntttttttttttttttttttttttttttttt

SEQ ID NO: 2324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannaagtggtgnntttttttttttttttttttttttttttttt

SEQ ID NO: 2325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannggagacaanntttttttttttttttttttttttttttttt

SEQ ID NO: 2326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntcaaggacnntttttttttttttttttttttttttttttt

SEQ ID NO: 2327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannaagagagcnntttttttttttttttttttttttttttttt

SEQ ID NO: 2328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncgagagatnntttttttttttttttttttttttttttttt

SEQ ID NO: 2329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannacagatggnntttttttttttttttttttttttttttttt

SEQ ID NO: 2330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannaggagtcanntttttttttttttttttttttttttttttt

SEQ ID NO: 2331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncgtgttacnntttttttttttttttttttttttttttttt

SEQ ID NO: 2332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntagtgtgcnntttttttttttttttttttttttttttttt

SEQ ID NO: 2333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannctcatgacnntttttttttttttttttttttttttttttt

SEQ ID NO: 2334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngtatccagnntttttttttttttttttttttttttttttt

SEQ ID NO: 2335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannacgcctatnntttttttttttttttttttttttttttttt

SEQ ID NO: 2336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannaacgacctnntttttttttttttttttttttttttttttt

SEQ ID NO: 2337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannatcaggctnntttttttttttttttttttttttttttttt

SEQ ID NO: 2338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncaagttcgnntttttttttttttttttttttttttttttt

SEQ ID NO: 2339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntagccaganntttttttttttttttttttttttttttttt

SEQ ID NO: 2340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncaatcacgnntttttttttttttttttttttttttttttt

SEQ ID NO: 2341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanngcaacaagnntttttttttttttttttttttttttttttt

SEQ ID NO: 2342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncacgacaanntttttttttttttttttttttttttttttt

SEQ ID NO: 2343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntacggaganntttttttttttttttttttttttttttttt

SEQ ID NO: 2344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncgacaaganntttttttttttttttttttttttttttttt

SEQ ID NO: 2345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncgaagtganntttttttttttttttttttttttttttttt

SEQ ID NO: 2346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannagctggtanntttttttttttttttttttttttttttttt

SEQ ID NO: 2347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannaactaggcnntttttttttttttttttttttttttttttt

SEQ ID NO: 2348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncagcaagtnntttttttttttttttttttttttttttttt

SEQ ID NO: 2349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannacgaggtanntttttttttttttttttttttttttttttt

SEQ ID NO: 2350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncatcttccnntttttttttttttttttttttttttttttt

SEQ ID NO: 2351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncctgaatcnntttttttttttttttttttttttttttttt

SEQ ID NO: 2352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanntgcagactnntttttttttttttttttttttttttttttt

SEQ ID NO: 2353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannagatgtggnntttttttttttttttttttttttttttttt

SEQ ID NO: 2354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannagttcgacnntttttttttttttttttttttttttttttt

SEQ ID NO: 2355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaannacaacctcnntttttttttttttttttttttttttttttt

SEQ ID NO: 2356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncatggtagnntttttttttttttttttttttttttttttt

SEQ ID NO: 2357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncgtatctcnntttttttttttttttttttttttttttttt

SEQ ID NO: 2358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncctagttcnntttttttttttttttttttttttttttttt

SEQ ID NO: 2359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgaggaanncaagagtcnntttttttttttttttttttttttttttttt

SEQ ID NO: 2360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnaatcggcanntttttttttttttttttttttttttttttt

SEQ ID NO: 2361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntacggcatnntttttttttttttttttttttttttttttt

SEQ ID NO: 2362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnttggatcgnntttttttttttttttttttttttttttttt

SEQ ID NO: 2363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntggaacganntttttttttttttttttttttttttttttt

SEQ ID NO: 2364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnggcaatcanntttttttttttttttttttttttttttttt

SEQ ID NO: 2365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngaatccganntttttttttttttttttttttttttttttt

SEQ ID NO: 2366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnttacggtgnntttttttttttttttttttttttttttttt

SEQ ID NO: 2367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncatatcggnntttttttttttttttttttttttttttttt

SEQ ID NO: 2368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncttcggtanntttttttttttttttttttttttttttttt

SEQ ID NO: 2369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntcctaacgnntttttttttttttttttttttttttttttt

SEQ ID NO: 2370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngtaagccanntttttttttttttttttttttttttttttt

SEQ ID NO: 2371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntaaggtggnntttttttttttttttttttttttttttttt

SEQ ID NO: 2372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnggtaagctnntttttttttttttttttttttttttttttt

SEQ ID NO: 2373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntgtgtcganntttttttttttttttttttttttttttttt

SEQ ID NO: 2374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngagcatganntttttttttttttttttttttttttttttt

SEQ ID NO: 2375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntcgaagtcnntttttttttttttttttttttttttttttt

SEQ ID NO: 2376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnggtgaacanntttttttttttttttttttttttttttttt

SEQ ID NO: 2377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnacatgcacnntttttttttttttttttttttttttttttt

SEQ ID NO: 2378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnccaacagtnntttttttttttttttttttttttttttttt

SEQ ID NO: 2379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnagaacagcnntttttttttttttttttttttttttttttt

SEQ ID NO: 2380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngaacacgtnntttttttttttttttttttttttttttttt

SEQ ID NO: 2381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnggtcttcanntttttttttttttttttttttttttttttt

SEQ ID NO: 2382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnaggttcagnntttttttttttttttttttttttttttttt

SEQ ID NO: 2383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnctagagcanntttttttttttttttttttttttttttttt

SEQ ID NO: 2384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncttctagcnntttttttttttttttttttttttttttttt

SEQ ID NO: 2385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngagtaacgnntttttttttttttttttttttttttttttt

SEQ ID NO: 2386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnctaagaggnntttttttttttttttttttttttttttttt

SEQ ID NO: 2387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnacgtgtagnntttttttttttttttttttttttttttttt

SEQ ID NO: 2388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnactacaggnntttttttttttttttttttttttttttttt

SEQ ID NO: 2389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntacaggtcnntttttttttttttttttttttttttttttt

SEQ ID NO: 2390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnctcacatgnntttttttttttttttttttttttttttttt

SEQ ID NO: 2391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnactaggagnntttttttttttttttttttttttttttttt

SEQ ID NO: 2392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnccatagganntttttttttttttttttttttttttttttt

SEQ ID NO: 2393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnggagaatcnntttttttttttttttttttttttttttttt

SEQ ID NO: 2394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngccaagaanntttttttttttttttttttttttttttttt

SEQ ID NO: 2395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnaaggcaagnntttttttttttttttttttttttttttttt

SEQ ID NO: 2396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnaatgtcgcnntttttttttttttttttttttttttttttt

SEQ ID NO: 2397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnatggaaccnntttttttttttttttttttttttttttttt

SEQ ID NO: 2398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnagaggcatnntttttttttttttttttttttttttttttt

SEQ ID NO: 2399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntgcatagcnntttttttttttttttttttttttttttttt

SEQ ID NO: 2400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnctaacgganntttttttttttttttttttttttttttttt

SEQ ID NO: 2401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntatcgaggnntttttttttttttttttttttttttttttt

SEQ ID NO: 2402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncatagcctnntttttttttttttttttttttttttttttt

SEQ ID NO: 2403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnatcgagacnntttttttttttttttttttttttttttttt

SEQ ID NO: 2404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnggaagagtnntttttttttttttttttttttttttttttt

SEQ ID NO: 2405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnccaagtagnntttttttttttttttttttttttttttttt

SEQ ID NO: 2406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnctgaacagnntttttttttttttttttttttttttttttt

SEQ ID NO: 2407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngtaggttcnntttttttttttttttttttttttttttttt

SEQ ID NO: 2408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngtatggacnntttttttttttttttttttttttttttttt

SEQ ID NO: 2409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntcgcaacanntttttttttttttttttttttttttttttt

SEQ ID NO: 2410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnccgctaatnntttttttttttttttttttttttttttttt

SEQ ID NO: 2411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngattcgcanntttttttttttttttttttttttttttttt

SEQ ID NO: 2412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncgatggaanntttttttttttttttttttttttttttttt

SEQ ID NO: 2413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnagcaagganntttttttttttttttttttttttttttttt

SEQ ID NO: 2414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncgtagcaanntttttttttttttttttttttttttttttt

SEQ ID NO: 2415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntggcagtanntttttttttttttttttttttttttttttt

SEQ ID NO: 2416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncggtagttnntttttttttttttttttttttttttttttt

SEQ ID NO: 2417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntgacttcgnntttttttttttttttttttttttttttttt

SEQ ID NO: 2418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngagtgcaanntttttttttttttttttttttttttttttt

SEQ ID NO: 2419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnacggtaacnntttttttttttttttttttttttttttttt

SEQ ID NO: 2420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnaagtggtgnntttttttttttttttttttttttttttttt

SEQ ID NO: 2421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnggagacaanntttttttttttttttttttttttttttttt

SEQ ID NO: 2422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntcaaggacnntttttttttttttttttttttttttttttt

SEQ ID NO: 2423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnaagagagcnntttttttttttttttttttttttttttttt

SEQ ID NO: 2424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncgagagatnntttttttttttttttttttttttttttttt

SEQ ID NO: 2425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnacagatggnntttttttttttttttttttttttttttttt

SEQ ID NO: 2426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnaggagtcanntttttttttttttttttttttttttttttt

SEQ ID NO: 2427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncgtgttacnntttttttttttttttttttttttttttttt

SEQ ID NO: 2428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntagtgtgcnntttttttttttttttttttttttttttttt

SEQ ID NO: 2429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnctcatgacnntttttttttttttttttttttttttttttt

SEQ ID NO: 2430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngtatccagnntttttttttttttttttttttttttttttt

SEQ ID NO: 2431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnacgcctatnntttttttttttttttttttttttttttttt

SEQ ID NO: 2432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnaacgacctnntttttttttttttttttttttttttttttt

SEQ ID NO: 2433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnatcaggctnntttttttttttttttttttttttttttttt

SEQ ID NO: 2434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncaagttcgnntttttttttttttttttttttttttttttt

SEQ ID NO: 2435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntagccaganntttttttttttttttttttttttttttttt

SEQ ID NO: 2436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncaatcacgnntttttttttttttttttttttttttttttt

SEQ ID NO: 2437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnngcaacaagnntttttttttttttttttttttttttttttt

SEQ ID NO: 2438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncacgacaanntttttttttttttttttttttttttttttt

SEQ ID NO: 2439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntacggaganntttttttttttttttttttttttttttttt

SEQ ID NO: 2440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncgacaaganntttttttttttttttttttttttttttttt

SEQ ID NO: 2441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncgaagtganntttttttttttttttttttttttttttttt

SEQ ID NO: 2442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnagctggtanntttttttttttttttttttttttttttttt

SEQ ID NO: 2443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnaactaggcnntttttttttttttttttttttttttttttt

SEQ ID NO: 2444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncagcaagtnntttttttttttttttttttttttttttttt

SEQ ID NO: 2445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnacgaggtanntttttttttttttttttttttttttttttt

SEQ ID NO: 2446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncatcttccnntttttttttttttttttttttttttttttt

SEQ ID NO: 2447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncctgaatcnntttttttttttttttttttttttttttttt

SEQ ID NO: 2448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnntgcagactnntttttttttttttttttttttttttttttt

SEQ ID NO: 2449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnagatgtggnntttttttttttttttttttttttttttttt

SEQ ID NO: 2450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnagttcgacnntttttttttttttttttttttttttttttt

SEQ ID NO: 2451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnnacaacctcnntttttttttttttttttttttttttttttt

SEQ ID NO: 2452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncatggtagnntttttttttttttttttttttttttttttt

SEQ ID NO: 2453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncgtatctcnntttttttttttttttttttttttttttttt

SEQ ID NO: 2454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncctagttcnntttttttttttttttttttttttttttttt

SEQ ID NO: 2455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggagatgnncaagagtcnntttttttttttttttttttttttttttttt

SEQ ID NO: 2456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannaatcggcanntttttttttttttttttttttttttttttt

SEQ ID NO: 2457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntacggcatnntttttttttttttttttttttttttttttt

SEQ ID NO: 2458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannttggatcgnntttttttttttttttttttttttttttttt

SEQ ID NO: 2459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntggaacganntttttttttttttttttttttttttttttt

SEQ ID NO: 2460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannggcaatcanntttttttttttttttttttttttttttttt

SEQ ID NO: 2461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngaatccganntttttttttttttttttttttttttttttt

SEQ ID NO: 2462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannttacggtgnntttttttttttttttttttttttttttttt

SEQ ID NO: 2463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncatatcggnntttttttttttttttttttttttttttttt

SEQ ID NO: 2464 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncttcggtanntttttttttttttttttttttttttttttt

SEQ ID NO: 2465 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntcctaacgnntttttttttttttttttttttttttttttt

SEQ ID NO: 2466 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngtaagccanntttttttttttttttttttttttttttttt

SEQ ID NO: 2467 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntaaggtggnntttttttttttttttttttttttttttttt

SEQ ID NO: 2468 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannggtaagctnntttttttttttttttttttttttttttttt

SEQ ID NO: 2469 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntgtgtcganntttttttttttttttttttttttttttttt

SEQ ID NO: 2470 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngagcatganntttttttttttttttttttttttttttttt

SEQ ID NO: 2471 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntcgaagtcnntttttttttttttttttttttttttttttt

SEQ ID NO: 2472 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannggtgaacanntttttttttttttttttttttttttttttt

SEQ ID NO: 2473 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannacatgcacnntttttttttttttttttttttttttttttt

SEQ ID NO: 2474 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannccaacagtnntttttttttttttttttttttttttttttt

SEQ ID NO: 2475 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannagaacagcnntttttttttttttttttttttttttttttt

SEQ ID NO: 2476 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngaacacgtnntttttttttttttttttttttttttttttt

SEQ ID NO: 2477 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannggtcttcanntttttttttttttttttttttttttttttt

SEQ ID NO: 2478 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannaggttcagnntttttttttttttttttttttttttttttt

SEQ ID NO: 2479 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannctagagcanntttttttttttttttttttttttttttttt

SEQ ID NO: 2480 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncttctagcnntttttttttttttttttttttttttttttt

SEQ ID NO: 2481 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngagtaacgnntttttttttttttttttttttttttttttt

SEQ ID NO: 2482 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannctaagaggnntttttttttttttttttttttttttttttt

SEQ ID NO: 2483 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannacgtgtagnntttttttttttttttttttttttttttttt

SEQ ID NO: 2484 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannactacaggnntttttttttttttttttttttttttttttt

SEQ ID NO: 2485 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntacaggtcnntttttttttttttttttttttttttttttt

SEQ ID NO: 2486 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannctcacatgnntttttttttttttttttttttttttttttt

SEQ ID NO: 2487 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannactaggagnntttttttttttttttttttttttttttttt

SEQ ID NO: 2488 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannccatagganntttttttttttttttttttttttttttttt

SEQ ID NO: 2489 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannggagaatcnntttttttttttttttttttttttttttttt

SEQ ID NO: 2490 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngccaagaanntttttttttttttttttttttttttttttt

SEQ ID NO: 2491 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannaaggcaagnntttttttttttttttttttttttttttttt

SEQ ID NO: 2492 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannaatgtcgcnntttttttttttttttttttttttttttttt

SEQ ID NO: 2493 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannatggaaccnntttttttttttttttttttttttttttttt

SEQ ID NO: 2494 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannagaggcatnntttttttttttttttttttttttttttttt

SEQ ID NO: 2495 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntgcatagcnntttttttttttttttttttttttttttttt

SEQ ID NO: 2496 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannctaacgganntttttttttttttttttttttttttttttt

SEQ ID NO: 2497 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntatcgaggnntttttttttttttttttttttttttttttt

SEQ ID NO: 2498 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncatagcctnntttttttttttttttttttttttttttttt

SEQ ID NO: 2499 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannatcgagacnntttttttttttttttttttttttttttttt

SEQ ID NO: 2500 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannggaagagtnntttttttttttttttttttttttttttttt

SEQ ID NO: 2501 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannccaagtagnntttttttttttttttttttttttttttttt

SEQ ID NO: 2502 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannctgaacagnntttttttttttttttttttttttttttttt

SEQ ID NO: 2503 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngtaggttcnntttttttttttttttttttttttttttttt

SEQ ID NO: 2504 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngtatggacnntttttttttttttttttttttttttttttt

SEQ ID NO: 2505 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntcgcaacanntttttttttttttttttttttttttttttt

SEQ ID NO: 2506 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannccgctaatnntttttttttttttttttttttttttttttt

SEQ ID NO: 2507 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngattcgcanntttttttttttttttttttttttttttttt

SEQ ID NO: 2508 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncgatggaanntttttttttttttttttttttttttttttt

SEQ ID NO: 2509 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannagcaagganntttttttttttttttttttttttttttttt

SEQ ID NO: 2510 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncgtagcaanntttttttttttttttttttttttttttttt

SEQ ID NO: 2511 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntggcagtanntttttttttttttttttttttttttttttt

SEQ ID NO: 2512 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncggtagttnntttttttttttttttttttttttttttttt

SEQ ID NO: 2513 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntgacttcgnntttttttttttttttttttttttttttttt

SEQ ID NO: 2514 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngagtgcaanntttttttttttttttttttttttttttttt

SEQ ID NO: 2515 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannacggtaacnntttttttttttttttttttttttttttttt

SEQ ID NO: 2516 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannaagtggtgnntttttttttttttttttttttttttttttt

SEQ ID NO: 2517 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannggagacaanntttttttttttttttttttttttttttttt

SEQ ID NO: 2518 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntcaaggacnntttttttttttttttttttttttttttttt

SEQ ID NO: 2519 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannaagagagcnntttttttttttttttttttttttttttttt

SEQ ID NO: 2520 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncgagagatnntttttttttttttttttttttttttttttt

SEQ ID NO: 2521 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannacagatggnntttttttttttttttttttttttttttttt

SEQ ID NO: 2522 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannaggagtcanntttttttttttttttttttttttttttttt

SEQ ID NO: 2523 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncgtgttacnntttttttttttttttttttttttttttttt

SEQ ID NO: 2524 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntagtgtgcnntttttttttttttttttttttttttttttt

SEQ ID NO: 2525 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannctcatgacnntttttttttttttttttttttttttttttt

SEQ ID NO: 2526 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngtatccagnntttttttttttttttttttttttttttttt

SEQ ID NO: 2527 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannacgcctatnntttttttttttttttttttttttttttttt

SEQ ID NO: 2528 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannaacgacctnntttttttttttttttttttttttttttttt

SEQ ID NO: 2529 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannatcaggctnntttttttttttttttttttttttttttttt

SEQ ID NO: 2530 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncaagttcgnntttttttttttttttttttttttttttttt

SEQ ID NO: 2531 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntagccaganntttttttttttttttttttttttttttttt

SEQ ID NO: 2532 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncaatcacgnntttttttttttttttttttttttttttttt

SEQ ID NO: 2533 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanngcaacaagnntttttttttttttttttttttttttttttt

SEQ ID NO: 2534 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncacgacaanntttttttttttttttttttttttttttttt

SEQ ID NO: 2535 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntacggaganntttttttttttttttttttttttttttttt

SEQ ID NO: 2536 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncgacaaganntttttttttttttttttttttttttttttt

SEQ ID NO: 2537 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncgaagtganntttttttttttttttttttttttttttttt

SEQ ID NO: 2538 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannagctggtanntttttttttttttttttttttttttttttt

SEQ ID NO: 2539 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannaactaggcnntttttttttttttttttttttttttttttt

SEQ ID NO: 2540 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncagcaagtnntttttttttttttttttttttttttttttt

SEQ ID NO: 2541 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannacgaggtanntttttttttttttttttttttttttttttt

SEQ ID NO: 2542 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncatcttccnntttttttttttttttttttttttttttttt

SEQ ID NO: 2543 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncctgaatcnntttttttttttttttttttttttttttttt

SEQ ID NO: 2544 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanntgcagactnntttttttttttttttttttttttttttttt

SEQ ID NO: 2545 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannagatgtggnntttttttttttttttttttttttttttttt

SEQ ID NO: 2546 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannagttcgacnntttttttttttttttttttttttttttttt

SEQ ID NO: 2547 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctannacaacctcnntttttttttttttttttttttttttttttt

SEQ ID NO: 2548 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncatggtagnntttttttttttttttttttttttttttttt

SEQ ID NO: 2549 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncgtatctcnntttttttttttttttttttttttttttttt

SEQ ID NO: 2550 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncctagttcnntttttttttttttttttttttttttttttt

SEQ ID NO: 2551 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggcctanncaagagtcnntttttttttttttttttttttttttttttt

SEQ ID NO: 2552 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnaatcggcanntttttttttttttttttttttttttttttt

SEQ ID NO: 2553 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntacggcatnntttttttttttttttttttttttttttttt

SEQ ID NO: 2554 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnttggatcgnntttttttttttttttttttttttttttttt

SEQ ID NO: 2555 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntggaacganntttttttttttttttttttttttttttttt

SEQ ID NO: 2556 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnggcaatcanntttttttttttttttttttttttttttttt

SEQ ID NO: 2557 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngaatccganntttttttttttttttttttttttttttttt

SEQ ID NO: 2558 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnttacggtgnntttttttttttttttttttttttttttttt

SEQ ID NO: 2559 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncatatcggnntttttttttttttttttttttttttttttt

SEQ ID NO: 2560 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncttcggtanntttttttttttttttttttttttttttttt

SEQ ID NO: 2561 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntcctaacgnntttttttttttttttttttttttttttttt

SEQ ID NO: 2562 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngtaagccanntttttttttttttttttttttttttttttt

SEQ ID NO: 2563 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntaaggtggnntttttttttttttttttttttttttttttt

SEQ ID NO: 2564 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnggtaagctnntttttttttttttttttttttttttttttt

SEQ ID NO: 2565 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntgtgtcganntttttttttttttttttttttttttttttt

SEQ ID NO: 2566 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngagcatganntttttttttttttttttttttttttttttt

SEQ ID NO: 2567 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntcgaagtcnntttttttttttttttttttttttttttttt

SEQ ID NO: 2568 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnggtgaacanntttttttttttttttttttttttttttttt

SEQ ID NO: 2569 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnacatgcacnntttttttttttttttttttttttttttttt

SEQ ID NO: 2570 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnccaacagtnntttttttttttttttttttttttttttttt

SEQ ID NO: 2571 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnagaacagcnntttttttttttttttttttttttttttttt

SEQ ID NO: 2572 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngaacacgtnntttttttttttttttttttttttttttttt

SEQ ID NO: 2573 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnggtcttcanntttttttttttttttttttttttttttttt

SEQ ID NO: 2574 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnaggttcagnntttttttttttttttttttttttttttttt

SEQ ID NO: 2575 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnctagagcanntttttttttttttttttttttttttttttt

SEQ ID NO: 2576 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncttctagcnntttttttttttttttttttttttttttttt

SEQ ID NO: 2577 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngagtaacgnntttttttttttttttttttttttttttttt

SEQ ID NO: 2578 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnctaagaggnntttttttttttttttttttttttttttttt

SEQ ID NO: 2579 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnacgtgtagnntttttttttttttttttttttttttttttt

SEQ ID NO: 2580 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnactacaggnntttttttttttttttttttttttttttttt

SEQ ID NO: 2581 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntacaggtcnntttttttttttttttttttttttttttttt

SEQ ID NO: 2582 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnctcacatgnntttttttttttttttttttttttttttttt

SEQ ID NO: 2583 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnactaggagnntttttttttttttttttttttttttttttt

SEQ ID NO: 2584 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnccatagganntttttttttttttttttttttttttttttt

SEQ ID NO: 2585 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnggagaatcnntttttttttttttttttttttttttttttt

SEQ ID NO: 2586 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngccaagaanntttttttttttttttttttttttttttttt

SEQ ID NO: 2587 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnaaggcaagnntttttttttttttttttttttttttttttt

SEQ ID NO: 2588 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnaatgtcgcnntttttttttttttttttttttttttttttt

SEQ ID NO: 2589 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnatggaaccnntttttttttttttttttttttttttttttt

SEQ ID NO: 2590 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnagaggcatnntttttttttttttttttttttttttttttt

SEQ ID NO: 2591 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntgcatagcnntttttttttttttttttttttttttttttt

SEQ ID NO: 2592 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnctaacgganntttttttttttttttttttttttttttttt

SEQ ID NO: 2593 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntatcgaggnntttttttttttttttttttttttttttttt

SEQ ID NO: 2594 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncatagcctnntttttttttttttttttttttttttttttt

SEQ ID NO: 2595 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnatcgagacnntttttttttttttttttttttttttttttt

SEQ ID NO: 2596 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnggaagagtnntttttttttttttttttttttttttttttt

SEQ ID NO: 2597 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnccaagtagnntttttttttttttttttttttttttttttt

SEQ ID NO: 2598 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnctgaacagnntttttttttttttttttttttttttttttt

SEQ ID NO: 2599 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngtaggttcnntttttttttttttttttttttttttttttt

SEQ ID NO: 2600 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngtatggacnntttttttttttttttttttttttttttttt

SEQ ID NO: 2601 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntcgcaacanntttttttttttttttttttttttttttttt

SEQ ID NO: 2602 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnccgctaatnntttttttttttttttttttttttttttttt

SEQ ID NO: 2603 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngattcgcanntttttttttttttttttttttttttttttt

SEQ ID NO: 2604 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncgatggaanntttttttttttttttttttttttttttttt

SEQ ID NO: 2605 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnagcaagganntttttttttttttttttttttttttttttt

SEQ ID NO: 2606 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncgtagcaanntttttttttttttttttttttttttttttt

SEQ ID NO: 2607 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntggcagtanntttttttttttttttttttttttttttttt

SEQ ID NO: 2608 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncggtagttnntttttttttttttttttttttttttttttt

SEQ ID NO: 2609 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntgacttcgnntttttttttttttttttttttttttttttt

SEQ ID NO: 2610 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngagtgcaanntttttttttttttttttttttttttttttt

SEQ ID NO: 2611 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnacggtaacnntttttttttttttttttttttttttttttt

SEQ ID NO: 2612 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnaagtggtgnntttttttttttttttttttttttttttttt

SEQ ID NO: 2613 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnggagacaanntttttttttttttttttttttttttttttt

SEQ ID NO: 2614 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntcaaggacnntttttttttttttttttttttttttttttt

SEQ ID NO: 2615 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnaagagagcnntttttttttttttttttttttttttttttt

SEQ ID NO: 2616 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncgagagatnntttttttttttttttttttttttttttttt

SEQ ID NO: 2617 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnacagatggnntttttttttttttttttttttttttttttt

SEQ ID NO: 2618 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnaggagtcanntttttttttttttttttttttttttttttt

SEQ ID NO: 2619 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncgtgttacnntttttttttttttttttttttttttttttt

SEQ ID NO: 2620 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntagtgtgcnntttttttttttttttttttttttttttttt

SEQ ID NO: 2621 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnctcatgacnntttttttttttttttttttttttttttttt

SEQ ID NO: 2622 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngtatccagnntttttttttttttttttttttttttttttt

SEQ ID NO: 2623 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnacgcctatnntttttttttttttttttttttttttttttt

SEQ ID NO: 2624 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnaacgacctnntttttttttttttttttttttttttttttt

SEQ ID NO: 2625 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnatcaggctnntttttttttttttttttttttttttttttt

SEQ ID NO: 2626 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncaagttcgnntttttttttttttttttttttttttttttt

SEQ ID NO: 2627 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntagccaganntttttttttttttttttttttttttttttt

SEQ ID NO: 2628 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncaatcacgnntttttttttttttttttttttttttttttt

SEQ ID NO: 2629 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnngcaacaagnntttttttttttttttttttttttttttttt

SEQ ID NO: 2630 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncacgacaanntttttttttttttttttttttttttttttt

SEQ ID NO: 2631 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntacggaganntttttttttttttttttttttttttttttt

SEQ ID NO: 2632 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncgacaaganntttttttttttttttttttttttttttttt

SEQ ID NO: 2633 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncgaagtganntttttttttttttttttttttttttttttt

SEQ ID NO: 2634 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnagctggtanntttttttttttttttttttttttttttttt

SEQ ID NO: 2635 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnaactaggcnntttttttttttttttttttttttttttttt

SEQ ID NO: 2636 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncagcaagtnntttttttttttttttttttttttttttttt

SEQ ID NO: 2637 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnacgaggtanntttttttttttttttttttttttttttttt

SEQ ID NO: 2638 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncatcttccnntttttttttttttttttttttttttttttt

SEQ ID NO: 2639 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncctgaatcnntttttttttttttttttttttttttttttt

SEQ ID NO: 2640 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnntgcagactnntttttttttttttttttttttttttttttt

SEQ ID NO: 2641 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnagatgtggnntttttttttttttttttttttttttttttt

SEQ ID NO: 2642 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnagttcgacnntttttttttttttttttttttttttttttt

SEQ ID NO: 2643 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnnacaacctcnntttttttttttttttttttttttttttttt

SEQ ID NO: 2644 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncatggtagnntttttttttttttttttttttttttttttt

SEQ ID NO: 2645 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncgtatctcnntttttttttttttttttttttttttttttt

SEQ ID NO: 2646 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncctagttcnntttttttttttttttttttttttttttttt

SEQ ID NO: 2647 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgtaatcgnncaagagtcnntttttttttttttttttttttttttttttt

SEQ ID NO: 2648 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnaatcggcanntttttttttttttttttttttttttttttt

SEQ ID NO: 2649 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntacggcatnntttttttttttttttttttttttttttttt

SEQ ID NO: 2650 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnttggatcgnntttttttttttttttttttttttttttttt

SEQ ID NO: 2651 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntggaacganntttttttttttttttttttttttttttttt

SEQ ID NO: 2652 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnggcaatcanntttttttttttttttttttttttttttttt

SEQ ID NO: 2653 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngaatccganntttttttttttttttttttttttttttttt

SEQ ID NO: 2654 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnttacggtgnntttttttttttttttttttttttttttttt

SEQ ID NO: 2655 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncatatcggnntttttttttttttttttttttttttttttt

SEQ ID NO: 2656 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncttcggtanntttttttttttttttttttttttttttttt

SEQ ID NO: 2657 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntcctaacgnntttttttttttttttttttttttttttttt

SEQ ID NO: 2658 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngtaagccanntttttttttttttttttttttttttttttt

SEQ ID NO: 2659 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntaaggtggnntttttttttttttttttttttttttttttt

SEQ ID NO: 2660 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnggtaagctnntttttttttttttttttttttttttttttt

SEQ ID NO: 2661 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntgtgtcganntttttttttttttttttttttttttttttt

SEQ ID NO: 2662 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngagcatganntttttttttttttttttttttttttttttt

SEQ ID NO: 2663 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntcgaagtcnntttttttttttttttttttttttttttttt

SEQ ID NO: 2664 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnggtgaacanntttttttttttttttttttttttttttttt

SEQ ID NO: 2665 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnacatgcacnntttttttttttttttttttttttttttttt

SEQ ID NO: 2666 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnccaacagtnntttttttttttttttttttttttttttttt

SEQ ID NO: 2667 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnagaacagcnntttttttttttttttttttttttttttttt

SEQ ID NO: 2668 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngaacacgtnntttttttttttttttttttttttttttttt

SEQ ID NO: 2669 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnggtcttcanntttttttttttttttttttttttttttttt

SEQ ID NO: 2670 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnaggttcagnntttttttttttttttttttttttttttttt

SEQ ID NO: 2671 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnctagagcanntttttttttttttttttttttttttttttt

SEQ ID NO: 2672 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncttctagcnntttttttttttttttttttttttttttttt

SEQ ID NO: 2673 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngagtaacgnntttttttttttttttttttttttttttttt

SEQ ID NO: 2674 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnctaagaggnntttttttttttttttttttttttttttttt

SEQ ID NO: 2675 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnacgtgtagnntttttttttttttttttttttttttttttt

SEQ ID NO: 2676 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnactacaggnntttttttttttttttttttttttttttttt

SEQ ID NO: 2677 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntacaggtcnntttttttttttttttttttttttttttttt

SEQ ID NO: 2678 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnctcacatgnntttttttttttttttttttttttttttttt

SEQ ID NO: 2679 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnactaggagnntttttttttttttttttttttttttttttt

SEQ ID NO: 2680 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnccatagganntttttttttttttttttttttttttttttt

SEQ ID NO: 2681 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnggagaatcnntttttttttttttttttttttttttttttt

SEQ ID NO: 2682 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngccaagaanntttttttttttttttttttttttttttttt

SEQ ID NO: 2683 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnaaggcaagnntttttttttttttttttttttttttttttt

SEQ ID NO: 2684 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnaatgtcgcnntttttttttttttttttttttttttttttt

SEQ ID NO: 2685 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnatggaaccnntttttttttttttttttttttttttttttt

SEQ ID NO: 2686 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnagaggcatnntttttttttttttttttttttttttttttt

SEQ ID NO: 2687 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntgcatagcnntttttttttttttttttttttttttttttt

SEQ ID NO: 2688 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnctaacgganntttttttttttttttttttttttttttttt

SEQ ID NO: 2689 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntatcgaggnntttttttttttttttttttttttttttttt

SEQ ID NO: 2690 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncatagcctnntttttttttttttttttttttttttttttt

SEQ ID NO: 2691 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnatcgagacnntttttttttttttttttttttttttttttt

SEQ ID NO: 2692 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnggaagagtnntttttttttttttttttttttttttttttt

SEQ ID NO: 2693 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnccaagtagnntttttttttttttttttttttttttttttt

SEQ ID NO: 2694 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnctgaacagnntttttttttttttttttttttttttttttt

SEQ ID NO: 2695 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngtaggttcnntttttttttttttttttttttttttttttt

SEQ ID NO: 2696 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngtatggacnntttttttttttttttttttttttttttttt

SEQ ID NO: 2697 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntcgcaacanntttttttttttttttttttttttttttttt

SEQ ID NO: 2698 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnccgctaatnntttttttttttttttttttttttttttttt

SEQ ID NO: 2699 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngattcgcanntttttttttttttttttttttttttttttt

SEQ ID NO: 2700 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncgatggaanntttttttttttttttttttttttttttttt

SEQ ID NO: 2701 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnagcaagganntttttttttttttttttttttttttttttt

SEQ ID NO: 2702 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncgtagcaanntttttttttttttttttttttttttttttt

SEQ ID NO: 2703 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntggcagtanntttttttttttttttttttttttttttttt

SEQ ID NO: 2704 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncggtagttnntttttttttttttttttttttttttttttt

SEQ ID NO: 2705 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntgacttcgnntttttttttttttttttttttttttttttt

SEQ ID NO: 2706 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngagtgcaanntttttttttttttttttttttttttttttt

SEQ ID NO: 2707 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnacggtaacnntttttttttttttttttttttttttttttt

SEQ ID NO: 2708 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnaagtggtgnntttttttttttttttttttttttttttttt

SEQ ID NO: 2709 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnggagacaanntttttttttttttttttttttttttttttt

SEQ ID NO: 2710 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntcaaggacnntttttttttttttttttttttttttttttt

SEQ ID NO: 2711 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnaagagagcnntttttttttttttttttttttttttttttt

SEQ ID NO: 2712 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncgagagatnntttttttttttttttttttttttttttttt

SEQ ID NO: 2713 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnacagatggnntttttttttttttttttttttttttttttt

SEQ ID NO: 2714 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnaggagtcanntttttttttttttttttttttttttttttt

SEQ ID NO: 2715 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncgtgttacnntttttttttttttttttttttttttttttt

SEQ ID NO: 2716 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntagtgtgcnntttttttttttttttttttttttttttttt

SEQ ID NO: 2717 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnctcatgacnntttttttttttttttttttttttttttttt

SEQ ID NO: 2718 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngtatccagnntttttttttttttttttttttttttttttt

SEQ ID NO: 2719 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnacgcctatnntttttttttttttttttttttttttttttt

SEQ ID NO: 2720 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnaacgacctnntttttttttttttttttttttttttttttt

SEQ ID NO: 2721 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnatcaggctnntttttttttttttttttttttttttttttt

SEQ ID NO: 2722 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncaagttcgnntttttttttttttttttttttttttttttt

SEQ ID NO: 2723 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntagccaganntttttttttttttttttttttttttttttt

SEQ ID NO: 2724 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncaatcacgnntttttttttttttttttttttttttttttt

SEQ ID NO: 2725 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnngcaacaagnntttttttttttttttttttttttttttttt

SEQ ID NO: 2726 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncacgacaanntttttttttttttttttttttttttttttt

SEQ ID NO: 2727 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntacggaganntttttttttttttttttttttttttttttt

SEQ ID NO: 2728 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncgacaaganntttttttttttttttttttttttttttttt

SEQ ID NO: 2729 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncgaagtganntttttttttttttttttttttttttttttt

SEQ ID NO: 2730 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnagctggtanntttttttttttttttttttttttttttttt

SEQ ID NO: 2731 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnaactaggcnntttttttttttttttttttttttttttttt

SEQ ID NO: 2732 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncagcaagtnntttttttttttttttttttttttttttttt

SEQ ID NO: 2733 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnacgaggtanntttttttttttttttttttttttttttttt

SEQ ID NO: 2734 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncatcttccnntttttttttttttttttttttttttttttt

SEQ ID NO: 2735 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncctgaatcnntttttttttttttttttttttttttttttt

SEQ ID NO: 2736 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnntgcagactnntttttttttttttttttttttttttttttt

SEQ ID NO: 2737 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnagatgtggnntttttttttttttttttttttttttttttt

SEQ ID NO: 2738 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnagttcgacnntttttttttttttttttttttttttttttt

SEQ ID NO: 2739 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnnacaacctcnntttttttttttttttttttttttttttttt

SEQ ID NO: 2740 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncatggtagnntttttttttttttttttttttttttttttt

SEQ ID NO: 2741 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncgtatctcnntttttttttttttttttttttttttttttt

SEQ ID NO: 2742 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncctagttcnntttttttttttttttttttttttttttttt

SEQ ID NO: 2743 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgagaaggnncaagagtcnntttttttttttttttttttttttttttttt

SEQ ID NO: 2744 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnaatcggcanntttttttttttttttttttttttttttttt

SEQ ID NO: 2745 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntacggcatnntttttttttttttttttttttttttttttt

SEQ ID NO: 2746 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnttggatcgnntttttttttttttttttttttttttttttt

SEQ ID NO: 2747 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntggaacganntttttttttttttttttttttttttttttt

SEQ ID NO: 2748 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnggcaatcanntttttttttttttttttttttttttttttt

SEQ ID NO: 2749 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngaatccganntttttttttttttttttttttttttttttt

SEQ ID NO: 2750 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnttacggtgnntttttttttttttttttttttttttttttt

SEQ ID NO: 2751 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncatatcggnntttttttttttttttttttttttttttttt

SEQ ID NO: 2752 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncttcggtanntttttttttttttttttttttttttttttt

SEQ ID NO: 2753 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntcctaacgnntttttttttttttttttttttttttttttt

SEQ ID NO: 2754 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngtaagccanntttttttttttttttttttttttttttttt

SEQ ID NO: 2755 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntaaggtggnntttttttttttttttttttttttttttttt

SEQ ID NO: 2756 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnggtaagctnntttttttttttttttttttttttttttttt

SEQ ID NO: 2757 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntgtgtcganntttttttttttttttttttttttttttttt

SEQ ID NO: 2758 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngagcatganntttttttttttttttttttttttttttttt

SEQ ID NO: 2759 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntcgaagtcnntttttttttttttttttttttttttttttt

SEQ ID NO: 2760 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnggtgaacanntttttttttttttttttttttttttttttt

SEQ ID NO: 2761 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnacatgcacnntttttttttttttttttttttttttttttt

SEQ ID NO: 2762 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnccaacagtnntttttttttttttttttttttttttttttt

SEQ ID NO: 2763 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnagaacagcnntttttttttttttttttttttttttttttt

SEQ ID NO: 2764 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngaacacgtnntttttttttttttttttttttttttttttt

SEQ ID NO: 2765 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnggtcttcanntttttttttttttttttttttttttttttt

SEQ ID NO: 2766 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnaggttcagnntttttttttttttttttttttttttttttt

SEQ ID NO: 2767 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnctagagcanntttttttttttttttttttttttttttttt

SEQ ID NO: 2768 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncttctagcnntttttttttttttttttttttttttttttt

SEQ ID NO: 2769 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngagtaacgnntttttttttttttttttttttttttttttt

SEQ ID NO: 2770 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnctaagaggnntttttttttttttttttttttttttttttt

SEQ ID NO: 2771 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnacgtgtagnntttttttttttttttttttttttttttttt

SEQ ID NO: 2772 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnactacaggnntttttttttttttttttttttttttttttt

SEQ ID NO: 2773 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntacaggtcnntttttttttttttttttttttttttttttt

SEQ ID NO: 2774 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnctcacatgnntttttttttttttttttttttttttttttt

SEQ ID NO: 2775 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnactaggagnntttttttttttttttttttttttttttttt

SEQ ID NO: 2776 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnccatagganntttttttttttttttttttttttttttttt

SEQ ID NO: 2777 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnggagaatcnntttttttttttttttttttttttttttttt

SEQ ID NO: 2778 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngccaagaanntttttttttttttttttttttttttttttt

SEQ ID NO: 2779 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnaaggcaagnntttttttttttttttttttttttttttttt

SEQ ID NO: 2780 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnaatgtcgcnntttttttttttttttttttttttttttttt

SEQ ID NO: 2781 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnatggaaccnntttttttttttttttttttttttttttttt

SEQ ID NO: 2782 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnagaggcatnntttttttttttttttttttttttttttttt

SEQ ID NO: 2783 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntgcatagcnntttttttttttttttttttttttttttttt

SEQ ID NO: 2784 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnctaacgganntttttttttttttttttttttttttttttt

SEQ ID NO: 2785 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntatcgaggnntttttttttttttttttttttttttttttt

SEQ ID NO: 2786 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncatagcctnntttttttttttttttttttttttttttttt

SEQ ID NO: 2787 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnatcgagacnntttttttttttttttttttttttttttttt

SEQ ID NO: 2788 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnggaagagtnntttttttttttttttttttttttttttttt

SEQ ID NO: 2789 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnccaagtagnntttttttttttttttttttttttttttttt

SEQ ID NO: 2790 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnctgaacagnntttttttttttttttttttttttttttttt

SEQ ID NO: 2791 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngtaggttcnntttttttttttttttttttttttttttttt

SEQ ID NO: 2792 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngtatggacnntttttttttttttttttttttttttttttt

SEQ ID NO: 2793 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntcgcaacanntttttttttttttttttttttttttttttt

SEQ ID NO: 2794 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnccgctaatnntttttttttttttttttttttttttttttt

SEQ ID NO: 2795 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngattcgcanntttttttttttttttttttttttttttttt

SEQ ID NO: 2796 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncgatggaanntttttttttttttttttttttttttttttt

SEQ ID NO: 2797 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnagcaagganntttttttttttttttttttttttttttttt

SEQ ID NO: 2798 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncgtagcaanntttttttttttttttttttttttttttttt

SEQ ID NO: 2799 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntggcagtanntttttttttttttttttttttttttttttt

SEQ ID NO: 2800 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncggtagttnntttttttttttttttttttttttttttttt

SEQ ID NO: 2801 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntgacttcgnntttttttttttttttttttttttttttttt

SEQ ID NO: 2802 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngagtgcaanntttttttttttttttttttttttttttttt

SEQ ID NO: 2803 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnacggtaacnntttttttttttttttttttttttttttttt

SEQ ID NO: 2804 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnaagtggtgnntttttttttttttttttttttttttttttt

SEQ ID NO: 2805 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnggagacaanntttttttttttttttttttttttttttttt

SEQ ID NO: 2806 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntcaaggacnntttttttttttttttttttttttttttttt

SEQ ID NO: 2807 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnaagagagcnntttttttttttttttttttttttttttttt

SEQ ID NO: 2808 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncgagagatnntttttttttttttttttttttttttttttt

SEQ ID NO: 2809 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnacagatggnntttttttttttttttttttttttttttttt

SEQ ID NO: 2810 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnaggagtcanntttttttttttttttttttttttttttttt

SEQ ID NO: 2811 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncgtgttacnntttttttttttttttttttttttttttttt

SEQ ID NO: 2812 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntagtgtgcnntttttttttttttttttttttttttttttt

SEQ ID NO: 2813 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnctcatgacnntttttttttttttttttttttttttttttt

SEQ ID NO: 2814 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngtatccagnntttttttttttttttttttttttttttttt

SEQ ID NO: 2815 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnacgcctatnntttttttttttttttttttttttttttttt

SEQ ID NO: 2816 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnaacgacctnntttttttttttttttttttttttttttttt

SEQ ID NO: 2817 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnatcaggctnntttttttttttttttttttttttttttttt

SEQ ID NO: 2818 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncaagttcgnntttttttttttttttttttttttttttttt

SEQ ID NO: 2819 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntagccaganntttttttttttttttttttttttttttttt

SEQ ID NO: 2820 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncaatcacgnntttttttttttttttttttttttttttttt

SEQ ID NO: 2821 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnngcaacaagnntttttttttttttttttttttttttttttt

SEQ ID NO: 2822 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncacgacaanntttttttttttttttttttttttttttttt

SEQ ID NO: 2823 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntacggaganntttttttttttttttttttttttttttttt

SEQ ID NO: 2824 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncgacaaganntttttttttttttttttttttttttttttt

SEQ ID NO: 2825 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncgaagtganntttttttttttttttttttttttttttttt

SEQ ID NO: 2826 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnagctggtanntttttttttttttttttttttttttttttt

SEQ ID NO: 2827 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnaactaggcnntttttttttttttttttttttttttttttt

SEQ ID NO: 2828 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncagcaagtnntttttttttttttttttttttttttttttt

SEQ ID NO: 2829 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnacgaggtanntttttttttttttttttttttttttttttt

SEQ ID NO: 2830 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncatcttccnntttttttttttttttttttttttttttttt

SEQ ID NO: 2831 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncctgaatcnntttttttttttttttttttttttttttttt

SEQ ID NO: 2832 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnntgcagactnntttttttttttttttttttttttttttttt

SEQ ID NO: 2833 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnagatgtggnntttttttttttttttttttttttttttttt

SEQ ID NO: 2834 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnagttcgacnntttttttttttttttttttttttttttttt

SEQ ID NO: 2835 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnnacaacctcnntttttttttttttttttttttttttttttt

SEQ ID NO: 2836 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncatggtagnntttttttttttttttttttttttttttttt

SEQ ID NO: 2837 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncgtatctcnntttttttttttttttttttttttttttttt

SEQ ID NO: 2838 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncctagttcnntttttttttttttttttttttttttttttt

SEQ ID NO: 2839 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcgatgtnncaagagtcnntttttttttttttttttttttttttttttt

SEQ ID NO: 2840 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnaatcggcanntttttttttttttttttttttttttttttt

SEQ ID NO: 2841 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntacggcatnntttttttttttttttttttttttttttttt

SEQ ID NO: 2842 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnttggatcgnntttttttttttttttttttttttttttttt

SEQ ID NO: 2843 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntggaacganntttttttttttttttttttttttttttttt

SEQ ID NO: 2844 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnggcaatcanntttttttttttttttttttttttttttttt

SEQ ID NO: 2845 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngaatccganntttttttttttttttttttttttttttttt

SEQ ID NO: 2846 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnttacggtgnntttttttttttttttttttttttttttttt

SEQ ID NO: 2847 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncatatcggnntttttttttttttttttttttttttttttt

SEQ ID NO: 2848 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncttcggtanntttttttttttttttttttttttttttttt

SEQ ID NO: 2849 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntcctaacgnntttttttttttttttttttttttttttttt

SEQ ID NO: 2850 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngtaagccanntttttttttttttttttttttttttttttt

SEQ ID NO: 2851 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntaaggtggnntttttttttttttttttttttttttttttt

SEQ ID NO: 2852 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnggtaagctnntttttttttttttttttttttttttttttt

SEQ ID NO: 2853 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntgtgtcganntttttttttttttttttttttttttttttt

SEQ ID NO: 2854 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngagcatganntttttttttttttttttttttttttttttt

SEQ ID NO: 2855 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntcgaagtcnntttttttttttttttttttttttttttttt

SEQ ID NO: 2856 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnggtgaacanntttttttttttttttttttttttttttttt

SEQ ID NO: 2857 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnacatgcacnntttttttttttttttttttttttttttttt

SEQ ID NO: 2858 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnccaacagtnntttttttttttttttttttttttttttttt

SEQ ID NO: 2859 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnagaacagcnntttttttttttttttttttttttttttttt

SEQ ID NO: 2860 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngaacacgtnntttttttttttttttttttttttttttttt

SEQ ID NO: 2861 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnggtcttcanntttttttttttttttttttttttttttttt

SEQ ID NO: 2862 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnaggttcagnntttttttttttttttttttttttttttttt

SEQ ID NO: 2863 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnctagagcanntttttttttttttttttttttttttttttt

SEQ ID NO: 2864 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncttctagcnntttttttttttttttttttttttttttttt

SEQ ID NO: 2865 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngagtaacgnntttttttttttttttttttttttttttttt

SEQ ID NO: 2866 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnctaagaggnntttttttttttttttttttttttttttttt

SEQ ID NO: 2867 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnacgtgtagnntttttttttttttttttttttttttttttt

SEQ ID NO: 2868 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnactacaggnntttttttttttttttttttttttttttttt

SEQ ID NO: 2869 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntacaggtcnntttttttttttttttttttttttttttttt

SEQ ID NO: 2870 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnctcacatgnntttttttttttttttttttttttttttttt

SEQ ID NO: 2871 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnactaggagnntttttttttttttttttttttttttttttt

SEQ ID NO: 2872 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnccatagganntttttttttttttttttttttttttttttt

SEQ ID NO: 2873 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnggagaatcnntttttttttttttttttttttttttttttt

SEQ ID NO: 2874 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngccaagaanntttttttttttttttttttttttttttttt

SEQ ID NO: 2875 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnaaggcaagnntttttttttttttttttttttttttttttt

SEQ ID NO: 2876 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnaatgtcgcnntttttttttttttttttttttttttttttt

SEQ ID NO: 2877 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnatggaaccnntttttttttttttttttttttttttttttt

SEQ ID NO: 2878 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnagaggcatnntttttttttttttttttttttttttttttt

SEQ ID NO: 2879 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntgcatagcnntttttttttttttttttttttttttttttt

SEQ ID NO: 2880 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnctaacgganntttttttttttttttttttttttttttttt

SEQ ID NO: 2881 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntatcgaggnntttttttttttttttttttttttttttttt

SEQ ID NO: 2882 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncatagcctnntttttttttttttttttttttttttttttt

SEQ ID NO: 2883 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnatcgagacnntttttttttttttttttttttttttttttt

SEQ ID NO: 2884 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnggaagagtnntttttttttttttttttttttttttttttt

SEQ ID NO: 2885 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnccaagtagnntttttttttttttttttttttttttttttt

SEQ ID NO: 2886 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnctgaacagnntttttttttttttttttttttttttttttt

SEQ ID NO: 2887 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngtaggttcnntttttttttttttttttttttttttttttt

SEQ ID NO: 2888 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngtatggacnntttttttttttttttttttttttttttttt

SEQ ID NO: 2889 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntcgcaacanntttttttttttttttttttttttttttttt

SEQ ID NO: 2890 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnccgctaatnntttttttttttttttttttttttttttttt

SEQ ID NO: 2891 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngattcgcanntttttttttttttttttttttttttttttt

SEQ ID NO: 2892 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncgatggaanntttttttttttttttttttttttttttttt

SEQ ID NO: 2893 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnagcaagganntttttttttttttttttttttttttttttt

SEQ ID NO: 2894 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncgtagcaanntttttttttttttttttttttttttttttt

SEQ ID NO: 2895 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntggcagtanntttttttttttttttttttttttttttttt

SEQ ID NO: 2896 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncggtagttnntttttttttttttttttttttttttttttt

SEQ ID NO: 2897 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntgacttcgnntttttttttttttttttttttttttttttt

SEQ ID NO: 2898 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngagtgcaanntttttttttttttttttttttttttttttt

SEQ ID NO: 2899 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnacggtaacnntttttttttttttttttttttttttttttt

SEQ ID NO: 2900 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnaagtggtgnntttttttttttttttttttttttttttttt

SEQ ID NO: 2901 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnggagacaanntttttttttttttttttttttttttttttt

SEQ ID NO: 2902 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntcaaggacnntttttttttttttttttttttttttttttt

SEQ ID NO: 2903 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnaagagagcnntttttttttttttttttttttttttttttt

SEQ ID NO: 2904 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncgagagatnntttttttttttttttttttttttttttttt

SEQ ID NO: 2905 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnacagatggnntttttttttttttttttttttttttttttt

SEQ ID NO: 2906 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnaggagtcanntttttttttttttttttttttttttttttt

SEQ ID NO: 2907 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncgtgttacnntttttttttttttttttttttttttttttt

SEQ ID NO: 2908 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntagtgtgcnntttttttttttttttttttttttttttttt

SEQ ID NO: 2909 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnctcatgacnntttttttttttttttttttttttttttttt

SEQ ID NO: 2910 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngtatccagnntttttttttttttttttttttttttttttt

SEQ ID NO: 2911 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnacgcctatnntttttttttttttttttttttttttttttt

SEQ ID NO: 2912 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnaacgacctnntttttttttttttttttttttttttttttt

SEQ ID NO: 2913 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnatcaggctnntttttttttttttttttttttttttttttt

SEQ ID NO: 2914 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncaagttcgnntttttttttttttttttttttttttttttt

SEQ ID NO: 2915 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntagccaganntttttttttttttttttttttttttttttt

SEQ ID NO: 2916 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncaatcacgnntttttttttttttttttttttttttttttt

SEQ ID NO: 2917 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnngcaacaagnntttttttttttttttttttttttttttttt

SEQ ID NO: 2918 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncacgacaanntttttttttttttttttttttttttttttt

SEQ ID NO: 2919 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntacggaganntttttttttttttttttttttttttttttt

SEQ ID NO: 2920 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncgacaaganntttttttttttttttttttttttttttttt

SEQ ID NO: 2921 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncgaagtganntttttttttttttttttttttttttttttt

SEQ ID NO: 2922 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnagctggtanntttttttttttttttttttttttttttttt

SEQ ID NO: 2923 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnaactaggcnntttttttttttttttttttttttttttttt

SEQ ID NO: 2924 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncagcaagtnntttttttttttttttttttttttttttttt

SEQ ID NO: 2925 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnacgaggtanntttttttttttttttttttttttttttttt

SEQ ID NO: 2926 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncatcttccnntttttttttttttttttttttttttttttt

SEQ ID NO: 2927 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncctgaatcnntttttttttttttttttttttttttttttt

SEQ ID NO: 2928 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnntgcagactnntttttttttttttttttttttttttttttt

SEQ ID NO: 2929 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnagatgtggnntttttttttttttttttttttttttttttt

SEQ ID NO: 2930 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnagttcgacnntttttttttttttttttttttttttttttt

SEQ ID NO: 2931 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnnacaacctcnntttttttttttttttttttttttttttttt

SEQ ID NO: 2932 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncatggtagnntttttttttttttttttttttttttttttt

SEQ ID NO: 2933 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncgtatctcnntttttttttttttttttttttttttttttt

SEQ ID NO: 2934 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncctagttcnntttttttttttttttttttttttttttttt

SEQ ID NO: 2935 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaaggactnncaagagtcnntttttttttttttttttttttttttttttt

SEQ ID NO: 2936 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnaatcggcanntttttttttttttttttttttttttttttt

SEQ ID NO: 2937 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntacggcatnntttttttttttttttttttttttttttttt

SEQ ID NO: 2938 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnttggatcgnntttttttttttttttttttttttttttttt

SEQ ID NO: 2939 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntggaacganntttttttttttttttttttttttttttttt

SEQ ID NO: 2940 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnggcaatcanntttttttttttttttttttttttttttttt

SEQ ID NO: 2941 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngaatccganntttttttttttttttttttttttttttttt

SEQ ID NO: 2942 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnttacggtgnntttttttttttttttttttttttttttttt

SEQ ID NO: 2943 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncatatcggnntttttttttttttttttttttttttttttt

SEQ ID NO: 2944 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncttcggtanntttttttttttttttttttttttttttttt

SEQ ID NO: 2945 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntcctaacgnntttttttttttttttttttttttttttttt

SEQ ID NO: 2946 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngtaagccanntttttttttttttttttttttttttttttt

SEQ ID NO: 2947 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntaaggtggnntttttttttttttttttttttttttttttt

SEQ ID NO: 2948 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnggtaagctnntttttttttttttttttttttttttttttt

SEQ ID NO: 2949 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntgtgtcganntttttttttttttttttttttttttttttt

SEQ ID NO: 2950 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngagcatganntttttttttttttttttttttttttttttt

SEQ ID NO: 2951 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntcgaagtcnntttttttttttttttttttttttttttttt

SEQ ID NO: 2952 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnggtgaacanntttttttttttttttttttttttttttttt

SEQ ID NO: 2953 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnacatgcacnntttttttttttttttttttttttttttttt

SEQ ID NO: 2954 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnccaacagtnntttttttttttttttttttttttttttttt

SEQ ID NO: 2955 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnagaacagcnntttttttttttttttttttttttttttttt

SEQ ID NO: 2956 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngaacacgtnntttttttttttttttttttttttttttttt

SEQ ID NO: 2957 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnggtcttcanntttttttttttttttttttttttttttttt

SEQ ID NO: 2958 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnaggttcagnntttttttttttttttttttttttttttttt

SEQ ID NO: 2959 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnctagagcanntttttttttttttttttttttttttttttt

SEQ ID NO: 2960 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncttctagcnntttttttttttttttttttttttttttttt

SEQ ID NO: 2961 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngagtaacgnntttttttttttttttttttttttttttttt

SEQ ID NO: 2962 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnctaagaggnntttttttttttttttttttttttttttttt

SEQ ID NO: 2963 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnacgtgtagnntttttttttttttttttttttttttttttt

SEQ ID NO: 2964 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnactacaggnntttttttttttttttttttttttttttttt

SEQ ID NO: 2965 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntacaggtcnntttttttttttttttttttttttttttttt

SEQ ID NO: 2966 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnctcacatgnntttttttttttttttttttttttttttttt

SEQ ID NO: 2967 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnactaggagnntttttttttttttttttttttttttttttt

SEQ ID NO: 2968 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnccatagganntttttttttttttttttttttttttttttt

SEQ ID NO: 2969 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnggagaatcnntttttttttttttttttttttttttttttt

SEQ ID NO: 2970 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngccaagaanntttttttttttttttttttttttttttttt

SEQ ID NO: 2971 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnaaggcaagnntttttttttttttttttttttttttttttt

SEQ ID NO: 2972 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnaatgtcgcnntttttttttttttttttttttttttttttt

SEQ ID NO: 2973 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnatggaaccnntttttttttttttttttttttttttttttt

SEQ ID NO: 2974 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnagaggcatnntttttttttttttttttttttttttttttt

SEQ ID NO: 2975 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntgcatagcnntttttttttttttttttttttttttttttt

SEQ ID NO: 2976 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnctaacgganntttttttttttttttttttttttttttttt

SEQ ID NO: 2977 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntatcgaggnntttttttttttttttttttttttttttttt

SEQ ID NO: 2978 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncatagcctnntttttttttttttttttttttttttttttt

SEQ ID NO: 2979 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnatcgagacnntttttttttttttttttttttttttttttt

SEQ ID NO: 2980 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnggaagagtnntttttttttttttttttttttttttttttt

SEQ ID NO: 2981 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnccaagtagnntttttttttttttttttttttttttttttt

SEQ ID NO: 2982 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnctgaacagnntttttttttttttttttttttttttttttt

SEQ ID NO: 2983 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngtaggttcnntttttttttttttttttttttttttttttt

SEQ ID NO: 2984 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngtatggacnntttttttttttttttttttttttttttttt

SEQ ID NO: 2985 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntcgcaacanntttttttttttttttttttttttttttttt

SEQ ID NO: 2986 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnccgctaatnntttttttttttttttttttttttttttttt

SEQ ID NO: 2987 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngattcgcanntttttttttttttttttttttttttttttt

SEQ ID NO: 2988 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncgatggaanntttttttttttttttttttttttttttttt

SEQ ID NO: 2989 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnagcaagganntttttttttttttttttttttttttttttt

SEQ ID NO: 2990 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncgtagcaanntttttttttttttttttttttttttttttt

SEQ ID NO: 2991 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntggcagtanntttttttttttttttttttttttttttttt

SEQ ID NO: 2992 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncggtagttnntttttttttttttttttttttttttttttt

SEQ ID NO: 2993 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntgacttcgnntttttttttttttttttttttttttttttt

SEQ ID NO: 2994 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngagtgcaanntttttttttttttttttttttttttttttt

SEQ ID NO: 2995 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnacggtaacnntttttttttttttttttttttttttttttt

SEQ ID NO: 2996 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnaagtggtgnntttttttttttttttttttttttttttttt

SEQ ID NO: 2997 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnggagacaanntttttttttttttttttttttttttttttt

SEQ ID NO: 2998 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntcaaggacnntttttttttttttttttttttttttttttt

SEQ ID NO: 2999 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnaagagagcnntttttttttttttttttttttttttttttt

SEQ ID NO: 3000 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncgagagatnntttttttttttttttttttttttttttttt

SEQ ID NO: 3001 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnacagatggnntttttttttttttttttttttttttttttt

SEQ ID NO: 3002 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnaggagtcanntttttttttttttttttttttttttttttt

SEQ ID NO: 3003 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncgtgttacnntttttttttttttttttttttttttttttt

SEQ ID NO: 3004 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntagtgtgcnntttttttttttttttttttttttttttttt

SEQ ID NO: 3005 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnctcatgacnntttttttttttttttttttttttttttttt

SEQ ID NO: 3006 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngtatccagnntttttttttttttttttttttttttttttt

SEQ ID NO: 3007 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnacgcctatnntttttttttttttttttttttttttttttt

SEQ ID NO: 3008 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnaacgacctnntttttttttttttttttttttttttttttt

SEQ ID NO: 3009 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnatcaggctnntttttttttttttttttttttttttttttt

SEQ ID NO: 3010 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncaagttcgnntttttttttttttttttttttttttttttt

SEQ ID NO: 3011 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntagccaganntttttttttttttttttttttttttttttt

SEQ ID NO: 3012 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncaatcacgnntttttttttttttttttttttttttttttt

SEQ ID NO: 3013 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnngcaacaagnntttttttttttttttttttttttttttttt

SEQ ID NO: 3014 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncacgacaanntttttttttttttttttttttttttttttt

SEQ ID NO: 3015 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntacggaganntttttttttttttttttttttttttttttt

SEQ ID NO: 3016 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncgacaaganntttttttttttttttttttttttttttttt

SEQ ID NO: 3017 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncgaagtganntttttttttttttttttttttttttttttt

SEQ ID NO: 3018 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnagctggtanntttttttttttttttttttttttttttttt

SEQ ID NO: 3019 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnaactaggcnntttttttttttttttttttttttttttttt

SEQ ID NO: 3020 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncagcaagtnntttttttttttttttttttttttttttttt

SEQ ID NO: 3021 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnacgaggtanntttttttttttttttttttttttttttttt

SEQ ID NO: 3022 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncatcttccnntttttttttttttttttttttttttttttt

SEQ ID NO: 3023 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncctgaatcnntttttttttttttttttttttttttttttt

SEQ ID NO: 3024 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnntgcagactnntttttttttttttttttttttttttttttt

SEQ ID NO: 3025 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnagatgtggnntttttttttttttttttttttttttttttt

SEQ ID NO: 3026 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnagttcgacnntttttttttttttttttttttttttttttt

SEQ ID NO: 3027 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnnacaacctcnntttttttttttttttttttttttttttttt

SEQ ID NO: 3028 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncatggtagnntttttttttttttttttttttttttttttt

SEQ ID NO: 3029 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncgtatctcnntttttttttttttttttttttttttttttt

SEQ ID NO: 3030 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncctagttcnntttttttttttttttttttttttttttttt

SEQ ID NO: 3031 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtagacctnncaagagtcnntttttttttttttttttttttttttttttt

SEQ ID NO: 3032 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnaatcggcanntttttttttttttttttttttttttttttt

SEQ ID NO: 3033 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntacggcatnntttttttttttttttttttttttttttttt

SEQ ID NO: 3034 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnttggatcgnntttttttttttttttttttttttttttttt

SEQ ID NO: 3035 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntggaacganntttttttttttttttttttttttttttttt

SEQ ID NO: 3036 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnggcaatcanntttttttttttttttttttttttttttttt

SEQ ID NO: 3037 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngaatccganntttttttttttttttttttttttttttttt

SEQ ID NO: 3038 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnttacggtgnntttttttttttttttttttttttttttttt

SEQ ID NO: 3039 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncatatcggnntttttttttttttttttttttttttttttt

SEQ ID NO: 3040 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncttcggtanntttttttttttttttttttttttttttttt

SEQ ID NO: 3041 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntcctaacgnntttttttttttttttttttttttttttttt

SEQ ID NO: 3042 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngtaagccanntttttttttttttttttttttttttttttt

SEQ ID NO: 3043 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntaaggtggnntttttttttttttttttttttttttttttt

SEQ ID NO: 3044 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnggtaagctnntttttttttttttttttttttttttttttt

SEQ ID NO: 3045 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntgtgtcganntttttttttttttttttttttttttttttt

SEQ ID NO: 3046 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngagcatganntttttttttttttttttttttttttttttt

SEQ ID NO: 3047 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntcgaagtcnntttttttttttttttttttttttttttttt

SEQ ID NO: 3048 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnggtgaacanntttttttttttttttttttttttttttttt

SEQ ID NO: 3049 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnacatgcacnntttttttttttttttttttttttttttttt

SEQ ID NO: 3050 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnccaacagtnntttttttttttttttttttttttttttttt

SEQ ID NO: 3051 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnagaacagcnntttttttttttttttttttttttttttttt

SEQ ID NO: 3052 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngaacacgtnntttttttttttttttttttttttttttttt

SEQ ID NO: 3053 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnggtcttcanntttttttttttttttttttttttttttttt

SEQ ID NO: 3054 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnaggttcagnntttttttttttttttttttttttttttttt

SEQ ID NO: 3055 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnctagagcanntttttttttttttttttttttttttttttt

SEQ ID NO: 3056 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncttctagcnntttttttttttttttttttttttttttttt

SEQ ID NO: 3057 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngagtaacgnntttttttttttttttttttttttttttttt

SEQ ID NO: 3058 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnctaagaggnntttttttttttttttttttttttttttttt

SEQ ID NO: 3059 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnacgtgtagnntttttttttttttttttttttttttttttt

SEQ ID NO: 3060 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnactacaggnntttttttttttttttttttttttttttttt

SEQ ID NO: 3061 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntacaggtcnntttttttttttttttttttttttttttttt

SEQ ID NO: 3062 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnctcacatgnntttttttttttttttttttttttttttttt

SEQ ID NO: 3063 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnactaggagnntttttttttttttttttttttttttttttt

SEQ ID NO: 3064 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnccatagganntttttttttttttttttttttttttttttt

SEQ ID NO: 3065 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnggagaatcnntttttttttttttttttttttttttttttt

SEQ ID NO: 3066 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngccaagaanntttttttttttttttttttttttttttttt

SEQ ID NO: 3067 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnaaggcaagnntttttttttttttttttttttttttttttt

SEQ ID NO: 3068 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnaatgtcgcnntttttttttttttttttttttttttttttt

SEQ ID NO: 3069 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnatggaaccnntttttttttttttttttttttttttttttt

SEQ ID NO: 3070 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnagaggcatnntttttttttttttttttttttttttttttt

SEQ ID NO: 3071 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntgcatagcnntttttttttttttttttttttttttttttt

SEQ ID NO: 3072 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnctaacgganntttttttttttttttttttttttttttttt

SEQ ID NO: 3073 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntatcgaggnntttttttttttttttttttttttttttttt

SEQ ID NO: 3074 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncatagcctnntttttttttttttttttttttttttttttt

SEQ ID NO: 3075 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnatcgagacnntttttttttttttttttttttttttttttt

SEQ ID NO: 3076 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnggaagagtnntttttttttttttttttttttttttttttt

SEQ ID NO: 3077 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnccaagtagnntttttttttttttttttttttttttttttt

SEQ ID NO: 3078 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnctgaacagnntttttttttttttttttttttttttttttt

SEQ ID NO: 3079 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngtaggttcnntttttttttttttttttttttttttttttt

SEQ ID NO: 3080 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngtatggacnntttttttttttttttttttttttttttttt

SEQ ID NO: 3081 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntcgcaacanntttttttttttttttttttttttttttttt

SEQ ID NO: 3082 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnccgctaatnntttttttttttttttttttttttttttttt

SEQ ID NO: 3083 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngattcgcanntttttttttttttttttttttttttttttt

SEQ ID NO: 3084 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncgatggaanntttttttttttttttttttttttttttttt

SEQ ID NO: 3085 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnagcaagganntttttttttttttttttttttttttttttt

SEQ ID NO: 3086 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncgtagcaanntttttttttttttttttttttttttttttt

SEQ ID NO: 3087 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntggcagtanntttttttttttttttttttttttttttttt

SEQ ID NO: 3088 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncggtagttnntttttttttttttttttttttttttttttt

SEQ ID NO: 3089 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntgacttcgnntttttttttttttttttttttttttttttt

SEQ ID NO: 3090 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngagtgcaanntttttttttttttttttttttttttttttt

SEQ ID NO: 3091 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnacggtaacnntttttttttttttttttttttttttttttt

SEQ ID NO: 3092 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnaagtggtgnntttttttttttttttttttttttttttttt

SEQ ID NO: 3093 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnggagacaanntttttttttttttttttttttttttttttt

SEQ ID NO: 3094 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntcaaggacnntttttttttttttttttttttttttttttt

SEQ ID NO: 3095 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnaagagagcnntttttttttttttttttttttttttttttt

SEQ ID NO: 3096 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncgagagatnntttttttttttttttttttttttttttttt

SEQ ID NO: 3097 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnacagatggnntttttttttttttttttttttttttttttt

SEQ ID NO: 3098 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnaggagtcanntttttttttttttttttttttttttttttt

SEQ ID NO: 3099 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncgtgttacnntttttttttttttttttttttttttttttt

SEQ ID NO: 3100 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntagtgtgcnntttttttttttttttttttttttttttttt

SEQ ID NO: 3101 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnctcatgacnntttttttttttttttttttttttttttttt

SEQ ID NO: 3102 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngtatccagnntttttttttttttttttttttttttttttt

SEQ ID NO: 3103 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnacgcctatnntttttttttttttttttttttttttttttt

SEQ ID NO: 3104 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnaacgacctnntttttttttttttttttttttttttttttt

SEQ ID NO: 3105 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnatcaggctnntttttttttttttttttttttttttttttt

SEQ ID NO: 3106 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncaagttcgnntttttttttttttttttttttttttttttt

SEQ ID NO: 3107 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntagccaganntttttttttttttttttttttttttttttt

SEQ ID NO: 3108 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncaatcacgnntttttttttttttttttttttttttttttt

SEQ ID NO: 3109 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnngcaacaagnntttttttttttttttttttttttttttttt

SEQ ID NO: 3110 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncacgacaanntttttttttttttttttttttttttttttt

SEQ ID NO: 3111 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntacggaganntttttttttttttttttttttttttttttt

SEQ ID NO: 3112 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncgacaaganntttttttttttttttttttttttttttttt

SEQ ID NO: 3113 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncgaagtganntttttttttttttttttttttttttttttt

SEQ ID NO: 3114 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnagctggtanntttttttttttttttttttttttttttttt

SEQ ID NO: 3115 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnaactaggcnntttttttttttttttttttttttttttttt

SEQ ID NO: 3116 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncagcaagtnntttttttttttttttttttttttttttttt

SEQ ID NO: 3117 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnacgaggtanntttttttttttttttttttttttttttttt

SEQ ID NO: 3118 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncatcttccnntttttttttttttttttttttttttttttt

SEQ ID NO: 3119 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncctgaatcnntttttttttttttttttttttttttttttt

SEQ ID NO: 3120 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnntgcagactnntttttttttttttttttttttttttttttt

SEQ ID NO: 3121 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnagatgtggnntttttttttttttttttttttttttttttt

SEQ ID NO: 3122 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnagttcgacnntttttttttttttttttttttttttttttt

SEQ ID NO: 3123 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnnacaacctcnntttttttttttttttttttttttttttttt

SEQ ID NO: 3124 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncatggtagnntttttttttttttttttttttttttttttt

SEQ ID NO: 3125 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncgtatctcnntttttttttttttttttttttttttttttt

SEQ ID NO: 3126 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncctagttcnntttttttttttttttttttttttttttttt

SEQ ID NO: 3127 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaattggcnncaagagtcnntttttttttttttttttttttttttttttt

SEQ ID NO: 3128 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnaatcggcanntttttttttttttttttttttttttttttt

SEQ ID NO: 3129 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntacggcatnntttttttttttttttttttttttttttttt

SEQ ID NO: 3130 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnttggatcgnntttttttttttttttttttttttttttttt

SEQ ID NO: 3131 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntggaacganntttttttttttttttttttttttttttttt

SEQ ID NO: 3132 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnggcaatcanntttttttttttttttttttttttttttttt

SEQ ID NO: 3133 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngaatccganntttttttttttttttttttttttttttttt

SEQ ID NO: 3134 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnttacggtgnntttttttttttttttttttttttttttttt

SEQ ID NO: 3135 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncatatcggnntttttttttttttttttttttttttttttt

SEQ ID NO: 3136 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncttcggtanntttttttttttttttttttttttttttttt

SEQ ID NO: 3137 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntcctaacgnntttttttttttttttttttttttttttttt

SEQ ID NO: 3138 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngtaagccanntttttttttttttttttttttttttttttt

SEQ ID NO: 3139 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntaaggtggnntttttttttttttttttttttttttttttt

SEQ ID NO: 3140 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnggtaagctnntttttttttttttttttttttttttttttt

SEQ ID NO: 3141 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntgtgtcganntttttttttttttttttttttttttttttt

SEQ ID NO: 3142 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngagcatganntttttttttttttttttttttttttttttt

SEQ ID NO: 3143 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntcgaagtcnntttttttttttttttttttttttttttttt

SEQ ID NO: 3144 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnggtgaacanntttttttttttttttttttttttttttttt

SEQ ID NO: 3145 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnacatgcacnntttttttttttttttttttttttttttttt

SEQ ID NO: 3146 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnccaacagtnntttttttttttttttttttttttttttttt

SEQ ID NO: 3147 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnagaacagcnntttttttttttttttttttttttttttttt

SEQ ID NO: 3148 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngaacacgtnntttttttttttttttttttttttttttttt

SEQ ID NO: 3149 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnggtcttcanntttttttttttttttttttttttttttttt

SEQ ID NO: 3150 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnaggttcagnntttttttttttttttttttttttttttttt

SEQ ID NO: 3151 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnctagagcanntttttttttttttttttttttttttttttt

SEQ ID NO: 3152 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncttctagcnntttttttttttttttttttttttttttttt

SEQ ID NO: 3153 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngagtaacgnntttttttttttttttttttttttttttttt

SEQ ID NO: 3154 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnctaagaggnntttttttttttttttttttttttttttttt

SEQ ID NO: 3155 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnacgtgtagnntttttttttttttttttttttttttttttt

SEQ ID NO: 3156 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnactacaggnntttttttttttttttttttttttttttttt

SEQ ID NO: 3157 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntacaggtcnntttttttttttttttttttttttttttttt

SEQ ID NO: 3158 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnctcacatgnntttttttttttttttttttttttttttttt

SEQ ID NO: 3159 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnactaggagnntttttttttttttttttttttttttttttt

SEQ ID NO: 3160 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnccatagganntttttttttttttttttttttttttttttt

SEQ ID NO: 3161 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnggagaatcnntttttttttttttttttttttttttttttt

SEQ ID NO: 3162 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngccaagaanntttttttttttttttttttttttttttttt

SEQ ID NO: 3163 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnaaggcaagnntttttttttttttttttttttttttttttt

SEQ ID NO: 3164 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnaatgtcgcnntttttttttttttttttttttttttttttt

SEQ ID NO: 3165 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnatggaaccnntttttttttttttttttttttttttttttt

SEQ ID NO: 3166 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnagaggcatnntttttttttttttttttttttttttttttt

SEQ ID NO: 3167 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntgcatagcnntttttttttttttttttttttttttttttt

SEQ ID NO: 3168 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnctaacgganntttttttttttttttttttttttttttttt

SEQ ID NO: 3169 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntatcgaggnntttttttttttttttttttttttttttttt

SEQ ID NO: 3170 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncatagcctnntttttttttttttttttttttttttttttt

SEQ ID NO: 3171 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnatcgagacnntttttttttttttttttttttttttttttt

SEQ ID NO: 3172 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnggaagagtnntttttttttttttttttttttttttttttt

SEQ ID NO: 3173 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnccaagtagnntttttttttttttttttttttttttttttt

SEQ ID NO: 3174 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnctgaacagnntttttttttttttttttttttttttttttt

SEQ ID NO: 3175 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngtaggttcnntttttttttttttttttttttttttttttt

SEQ ID NO: 3176 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngtatggacnntttttttttttttttttttttttttttttt

SEQ ID NO: 3177 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntcgcaacanntttttttttttttttttttttttttttttt

SEQ ID NO: 3178 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnccgctaatnntttttttttttttttttttttttttttttt

SEQ ID NO: 3179 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngattcgcanntttttttttttttttttttttttttttttt

SEQ ID NO: 3180 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncgatggaanntttttttttttttttttttttttttttttt

SEQ ID NO: 3181 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnagcaagganntttttttttttttttttttttttttttttt

SEQ ID NO: 3182 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncgtagcaanntttttttttttttttttttttttttttttt

SEQ ID NO: 3183 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntggcagtanntttttttttttttttttttttttttttttt

SEQ ID NO: 3184 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncggtagttnntttttttttttttttttttttttttttttt

SEQ ID NO: 3185 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntgacttcgnntttttttttttttttttttttttttttttt

SEQ ID NO: 3186 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngagtgcaanntttttttttttttttttttttttttttttt

SEQ ID NO: 3187 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnacggtaacnntttttttttttttttttttttttttttttt

SEQ ID NO: 3188 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnaagtggtgnntttttttttttttttttttttttttttttt

SEQ ID NO: 3189 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnggagacaanntttttttttttttttttttttttttttttt

SEQ ID NO: 3190 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntcaaggacnntttttttttttttttttttttttttttttt

SEQ ID NO: 3191 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnaagagagcnntttttttttttttttttttttttttttttt

SEQ ID NO: 3192 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncgagagatnntttttttttttttttttttttttttttttt

SEQ ID NO: 3193 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnacagatggnntttttttttttttttttttttttttttttt

SEQ ID NO: 3194 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnaggagtcanntttttttttttttttttttttttttttttt

SEQ ID NO: 3195 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncgtgttacnntttttttttttttttttttttttttttttt

SEQ ID NO: 3196 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntagtgtgcnntttttttttttttttttttttttttttttt

SEQ ID NO: 3197 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnctcatgacnntttttttttttttttttttttttttttttt

SEQ ID NO: 3198 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngtatccagnntttttttttttttttttttttttttttttt

SEQ ID NO: 3199 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnacgcctatnntttttttttttttttttttttttttttttt

SEQ ID NO: 3200 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnaacgacctnntttttttttttttttttttttttttttttt

SEQ ID NO: 3201 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnatcaggctnntttttttttttttttttttttttttttttt

SEQ ID NO: 3202 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncaagttcgnntttttttttttttttttttttttttttttt

SEQ ID NO: 3203 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntagccaganntttttttttttttttttttttttttttttt

SEQ ID NO: 3204 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncaatcacgnntttttttttttttttttttttttttttttt

SEQ ID NO: 3205 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnngcaacaagnntttttttttttttttttttttttttttttt

SEQ ID NO: 3206 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncacgacaanntttttttttttttttttttttttttttttt

SEQ ID NO: 3207 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntacggaganntttttttttttttttttttttttttttttt

SEQ ID NO: 3208 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncgacaaganntttttttttttttttttttttttttttttt

SEQ ID NO: 3209 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncgaagtganntttttttttttttttttttttttttttttt

SEQ ID NO: 3210 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnagctggtanntttttttttttttttttttttttttttttt

SEQ ID NO: 3211 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnaactaggcnntttttttttttttttttttttttttttttt

SEQ ID NO: 3212 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncagcaagtnntttttttttttttttttttttttttttttt

SEQ ID NO: 3213 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnacgaggtanntttttttttttttttttttttttttttttt

SEQ ID NO: 3214 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncatcttccnntttttttttttttttttttttttttttttt

SEQ ID NO: 3215 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncctgaatcnntttttttttttttttttttttttttttttt

SEQ ID NO: 3216 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnntgcagactnntttttttttttttttttttttttttttttt

SEQ ID NO: 3217 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnagatgtggnntttttttttttttttttttttttttttttt

SEQ ID NO: 3218 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnagttcgacnntttttttttttttttttttttttttttttt

SEQ ID NO: 3219 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnnacaacctcnntttttttttttttttttttttttttttttt

SEQ ID NO: 3220 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncatggtagnntttttttttttttttttttttttttttttt

SEQ ID NO: 3221 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncgtatctcnntttttttttttttttttttttttttttttt

SEQ ID NO: 3222 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncctagttcnntttttttttttttttttttttttttttttt

SEQ ID NO: 3223 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcgaatggnncaagagtcnntttttttttttttttttttttttttttttt

SEQ ID NO: 3224 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannaatcggcanntttttttttttttttttttttttttttttt

SEQ ID NO: 3225 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntacggcatnntttttttttttttttttttttttttttttt

SEQ ID NO: 3226 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannttggatcgnntttttttttttttttttttttttttttttt

SEQ ID NO: 3227 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntggaacganntttttttttttttttttttttttttttttt

SEQ ID NO: 3228 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannggcaatcanntttttttttttttttttttttttttttttt

SEQ ID NO: 3229 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngaatccganntttttttttttttttttttttttttttttt

SEQ ID NO: 3230 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannttacggtgnntttttttttttttttttttttttttttttt

SEQ ID NO: 3231 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncatatcggnntttttttttttttttttttttttttttttt

SEQ ID NO: 3232 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncttcggtanntttttttttttttttttttttttttttttt

SEQ ID NO: 3233 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntcctaacgnntttttttttttttttttttttttttttttt

SEQ ID NO: 3234 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngtaagccanntttttttttttttttttttttttttttttt

SEQ ID NO: 3235 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntaaggtggnntttttttttttttttttttttttttttttt

SEQ ID NO: 3236 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannggtaagctnntttttttttttttttttttttttttttttt

SEQ ID NO: 3237 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntgtgtcganntttttttttttttttttttttttttttttt

SEQ ID NO: 3238 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngagcatganntttttttttttttttttttttttttttttt

SEQ ID NO: 3239 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntcgaagtcnntttttttttttttttttttttttttttttt

SEQ ID NO: 3240 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannggtgaacanntttttttttttttttttttttttttttttt

SEQ ID NO: 3241 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannacatgcacnntttttttttttttttttttttttttttttt

SEQ ID NO: 3242 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannccaacagtnntttttttttttttttttttttttttttttt

SEQ ID NO: 3243 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannagaacagcnntttttttttttttttttttttttttttttt

SEQ ID NO: 3244 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngaacacgtnntttttttttttttttttttttttttttttt

SEQ ID NO: 3245 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannggtcttcanntttttttttttttttttttttttttttttt

SEQ ID NO: 3246 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannaggttcagnntttttttttttttttttttttttttttttt

SEQ ID NO: 3247 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannctagagcanntttttttttttttttttttttttttttttt

SEQ ID NO: 3248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncttctagcnntttttttttttttttttttttttttttttt

SEQ ID NO: 3249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngagtaacgnntttttttttttttttttttttttttttttt

SEQ ID NO: 3250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannctaagaggnntttttttttttttttttttttttttttttt

SEQ ID NO: 3251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannacgtgtagnntttttttttttttttttttttttttttttt

SEQ ID NO: 3252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannactacaggnntttttttttttttttttttttttttttttt

SEQ ID NO: 3253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntacaggtcnntttttttttttttttttttttttttttttt

SEQ ID NO: 3254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannctcacatgnntttttttttttttttttttttttttttttt

SEQ ID NO: 3255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannactaggagnntttttttttttttttttttttttttttttt

SEQ ID NO: 3256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannccatagganntttttttttttttttttttttttttttttt

SEQ ID NO: 3257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannggagaatcnntttttttttttttttttttttttttttttt

SEQ ID NO: 3258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngccaagaanntttttttttttttttttttttttttttttt

SEQ ID NO: 3259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannaaggcaagnntttttttttttttttttttttttttttttt

SEQ ID NO: 3260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannaatgtcgcnntttttttttttttttttttttttttttttt

SEQ ID NO: 3261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannatggaaccnntttttttttttttttttttttttttttttt

SEQ ID NO: 3262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannagaggcatnntttttttttttttttttttttttttttttt

SEQ ID NO: 3263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntgcatagcnntttttttttttttttttttttttttttttt

SEQ ID NO: 3264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannctaacgganntttttttttttttttttttttttttttttt

SEQ ID NO: 3265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntatcgaggnntttttttttttttttttttttttttttttt

SEQ ID NO: 3266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncatagcctnntttttttttttttttttttttttttttttt

SEQ ID NO: 3267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannatcgagacnntttttttttttttttttttttttttttttt

SEQ ID NO: 3268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannggaagagtnntttttttttttttttttttttttttttttt

SEQ ID NO: 3269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannccaagtagnntttttttttttttttttttttttttttttt

SEQ ID NO: 3270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannctgaacagnntttttttttttttttttttttttttttttt

SEQ ID NO: 3271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngtaggttcnntttttttttttttttttttttttttttttt

SEQ ID NO: 3272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngtatggacnntttttttttttttttttttttttttttttt

SEQ ID NO: 3273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntcgcaacanntttttttttttttttttttttttttttttt

SEQ ID NO: 3274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannccgctaatnntttttttttttttttttttttttttttttt

SEQ ID NO: 3275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngattcgcanntttttttttttttttttttttttttttttt

SEQ ID NO: 3276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncgatggaanntttttttttttttttttttttttttttttt

SEQ ID NO: 3277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannagcaagganntttttttttttttttttttttttttttttt

SEQ ID NO: 3278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncgtagcaanntttttttttttttttttttttttttttttt

SEQ ID NO: 3279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntggcagtanntttttttttttttttttttttttttttttt

SEQ ID NO: 3280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncggtagttnntttttttttttttttttttttttttttttt

SEQ ID NO: 3281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntgacttcgnntttttttttttttttttttttttttttttt

SEQ ID NO: 3282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngagtgcaanntttttttttttttttttttttttttttttt

SEQ ID NO: 3283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannacggtaacnntttttttttttttttttttttttttttttt

SEQ ID NO: 3284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannaagtggtgnntttttttttttttttttttttttttttttt

SEQ ID NO: 3285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannggagacaanntttttttttttttttttttttttttttttt

SEQ ID NO: 3286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntcaaggacnntttttttttttttttttttttttttttttt

SEQ ID NO: 3287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannaagagagcnntttttttttttttttttttttttttttttt

SEQ ID NO: 3288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncgagagatnntttttttttttttttttttttttttttttt

SEQ ID NO: 3289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannacagatggnntttttttttttttttttttttttttttttt

SEQ ID NO: 3290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannaggagtcanntttttttttttttttttttttttttttttt

SEQ ID NO: 3291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncgtgttacnntttttttttttttttttttttttttttttt

SEQ ID NO: 3292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntagtgtgcnntttttttttttttttttttttttttttttt

SEQ ID NO: 3293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannctcatgacnntttttttttttttttttttttttttttttt

SEQ ID NO: 3294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngtatccagnntttttttttttttttttttttttttttttt

SEQ ID NO: 3295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannacgcctatnntttttttttttttttttttttttttttttt

SEQ ID NO: 3296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannaacgacctnntttttttttttttttttttttttttttttt

SEQ ID NO: 3297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannatcaggctnntttttttttttttttttttttttttttttt

SEQ ID NO: 3298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncaagttcgnntttttttttttttttttttttttttttttt

SEQ ID NO: 3299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntagccaganntttttttttttttttttttttttttttttt

SEQ ID NO: 3300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncaatcacgnntttttttttttttttttttttttttttttt

SEQ ID NO: 3301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanngcaacaagnntttttttttttttttttttttttttttttt

SEQ ID NO: 3302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncacgacaanntttttttttttttttttttttttttttttt

SEQ ID NO: 3303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntacggaganntttttttttttttttttttttttttttttt

SEQ ID NO: 3304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncgacaaganntttttttttttttttttttttttttttttt

SEQ ID NO: 3305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncgaagtganntttttttttttttttttttttttttttttt

SEQ ID NO: 3306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannagctggtanntttttttttttttttttttttttttttttt

SEQ ID NO: 3307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannaactaggcnntttttttttttttttttttttttttttttt

SEQ ID NO: 3308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncagcaagtnntttttttttttttttttttttttttttttt

SEQ ID NO: 3309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannacgaggtanntttttttttttttttttttttttttttttt

SEQ ID NO: 3310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncatcttccnntttttttttttttttttttttttttttttt

SEQ ID NO: 3311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncctgaatcnntttttttttttttttttttttttttttttt

SEQ ID NO: 3312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanntgcagactnntttttttttttttttttttttttttttttt

SEQ ID NO: 3313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannagatgtggnntttttttttttttttttttttttttttttt

SEQ ID NO: 3314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannagttcgacnntttttttttttttttttttttttttttttt

SEQ ID NO: 3315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcannacaacctcnntttttttttttttttttttttttttttttt

SEQ ID NO: 3316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncatggtagnntttttttttttttttttttttttttttttt

SEQ ID NO: 3317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncgtatctcnntttttttttttttttttttttttttttttt

SEQ ID NO: 3318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncctagttcnntttttttttttttttttttttttttttttt

SEQ ID NO: 3319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggtgcanncaagagtcnntttttttttttttttttttttttttttttt

SEQ ID NO: 3320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannaatcggcanntttttttttttttttttttttttttttttt

SEQ ID NO: 3321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntacggcatnntttttttttttttttttttttttttttttt

SEQ ID NO: 3322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannttggatcgnntttttttttttttttttttttttttttttt

SEQ ID NO: 3323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntggaacganntttttttttttttttttttttttttttttt

SEQ ID NO: 3324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannggcaatcanntttttttttttttttttttttttttttttt

SEQ ID NO: 3325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngaatccganntttttttttttttttttttttttttttttt

SEQ ID NO: 3326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannttacggtgnntttttttttttttttttttttttttttttt

SEQ ID NO: 3327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncatatcggnntttttttttttttttttttttttttttttt

SEQ ID NO: 3328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncttcggtanntttttttttttttttttttttttttttttt

SEQ ID NO: 3329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntcctaacgnntttttttttttttttttttttttttttttt

SEQ ID NO: 3330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngtaagccanntttttttttttttttttttttttttttttt

SEQ ID NO: 3331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntaaggtggnntttttttttttttttttttttttttttttt

SEQ ID NO: 3332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannggtaagctnntttttttttttttttttttttttttttttt

SEQ ID NO: 3333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntgtgtcganntttttttttttttttttttttttttttttt

SEQ ID NO: 3334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngagcatganntttttttttttttttttttttttttttttt

SEQ ID NO: 3335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntcgaagtcnntttttttttttttttttttttttttttttt

SEQ ID NO: 3336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannggtgaacanntttttttttttttttttttttttttttttt

SEQ ID NO: 3337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannacatgcacnntttttttttttttttttttttttttttttt

SEQ ID NO: 3338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannccaacagtnntttttttttttttttttttttttttttttt

SEQ ID NO: 3339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannagaacagcnntttttttttttttttttttttttttttttt

SEQ ID NO: 3340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngaacacgtnntttttttttttttttttttttttttttttt

SEQ ID NO: 3341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannggtcttcanntttttttttttttttttttttttttttttt

SEQ ID NO: 3342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannaggttcagnntttttttttttttttttttttttttttttt

SEQ ID NO: 3343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannctagagcanntttttttttttttttttttttttttttttt

SEQ ID NO: 3344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncttctagcnntttttttttttttttttttttttttttttt

SEQ ID NO: 3345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngagtaacgnntttttttttttttttttttttttttttttt

SEQ ID NO: 3346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannctaagaggnntttttttttttttttttttttttttttttt

SEQ ID NO: 3347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannacgtgtagnntttttttttttttttttttttttttttttt

SEQ ID NO: 3348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannactacaggnntttttttttttttttttttttttttttttt

SEQ ID NO: 3349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntacaggtcnntttttttttttttttttttttttttttttt

SEQ ID NO: 3350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannctcacatgnntttttttttttttttttttttttttttttt

SEQ ID NO: 3351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannactaggagnntttttttttttttttttttttttttttttt

SEQ ID NO: 3352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannccatagganntttttttttttttttttttttttttttttt

SEQ ID NO: 3353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannggagaatcnntttttttttttttttttttttttttttttt

SEQ ID NO: 3354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngccaagaanntttttttttttttttttttttttttttttt

SEQ ID NO: 3355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannaaggcaagnntttttttttttttttttttttttttttttt

SEQ ID NO: 3356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannaatgtcgcnntttttttttttttttttttttttttttttt

SEQ ID NO: 3357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannatggaaccnntttttttttttttttttttttttttttttt

SEQ ID NO: 3358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannagaggcatnntttttttttttttttttttttttttttttt

SEQ ID NO: 3359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntgcatagcnntttttttttttttttttttttttttttttt

SEQ ID NO: 3360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannctaacgganntttttttttttttttttttttttttttttt

SEQ ID NO: 3361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntatcgaggnntttttttttttttttttttttttttttttt

SEQ ID NO: 3362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncatagcctnntttttttttttttttttttttttttttttt

SEQ ID NO: 3363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannatcgagacnntttttttttttttttttttttttttttttt

SEQ ID NO: 3364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannggaagagtnntttttttttttttttttttttttttttttt

SEQ ID NO: 3365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannccaagtagnntttttttttttttttttttttttttttttt

SEQ ID NO: 3366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannctgaacagnntttttttttttttttttttttttttttttt

SEQ ID NO: 3367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngtaggttcnntttttttttttttttttttttttttttttt

SEQ ID NO: 3368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngtatggacnntttttttttttttttttttttttttttttt

SEQ ID NO: 3369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntcgcaacanntttttttttttttttttttttttttttttt

SEQ ID NO: 3370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannccgctaatnntttttttttttttttttttttttttttttt

SEQ ID NO: 3371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngattcgcanntttttttttttttttttttttttttttttt

SEQ ID NO: 3372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncgatggaanntttttttttttttttttttttttttttttt

SEQ ID NO: 3373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannagcaagganntttttttttttttttttttttttttttttt

SEQ ID NO: 3374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncgtagcaanntttttttttttttttttttttttttttttt

SEQ ID NO: 3375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntggcagtanntttttttttttttttttttttttttttttt

SEQ ID NO: 3376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncggtagttnntttttttttttttttttttttttttttttt

SEQ ID NO: 3377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntgacttcgnntttttttttttttttttttttttttttttt

SEQ ID NO: 3378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngagtgcaanntttttttttttttttttttttttttttttt

SEQ ID NO: 3379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannacggtaacnntttttttttttttttttttttttttttttt

SEQ ID NO: 3380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannaagtggtgnntttttttttttttttttttttttttttttt

SEQ ID NO: 3381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannggagacaanntttttttttttttttttttttttttttttt

SEQ ID NO: 3382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntcaaggacnntttttttttttttttttttttttttttttt

SEQ ID NO: 3383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannaagagagcnntttttttttttttttttttttttttttttt

SEQ ID NO: 3384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncgagagatnntttttttttttttttttttttttttttttt

SEQ ID NO: 3385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannacagatggnntttttttttttttttttttttttttttttt

SEQ ID NO: 3386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannaggagtcanntttttttttttttttttttttttttttttt

SEQ ID NO: 3387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncgtgttacnntttttttttttttttttttttttttttttt

SEQ ID NO: 3388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntagtgtgcnntttttttttttttttttttttttttttttt

SEQ ID NO: 3389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannctcatgacnntttttttttttttttttttttttttttttt

SEQ ID NO: 3390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngtatccagnntttttttttttttttttttttttttttttt

SEQ ID NO: 3391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannacgcctatnntttttttttttttttttttttttttttttt

SEQ ID NO: 3392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannaacgacctnntttttttttttttttttttttttttttttt

SEQ ID NO: 3393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannatcaggctnntttttttttttttttttttttttttttttt

SEQ ID NO: 3394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncaagttcgnntttttttttttttttttttttttttttttt

SEQ ID NO: 3395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntagccaganntttttttttttttttttttttttttttttt

SEQ ID NO: 3396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncaatcacgnntttttttttttttttttttttttttttttt

SEQ ID NO: 3397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganngcaacaagnntttttttttttttttttttttttttttttt

SEQ ID NO: 3398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncacgacaanntttttttttttttttttttttttttttttt

SEQ ID NO: 3399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntacggaganntttttttttttttttttttttttttttttt

SEQ ID NO: 3400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncgacaaganntttttttttttttttttttttttttttttt

SEQ ID NO: 3401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncgaagtganntttttttttttttttttttttttttttttt

SEQ ID NO: 3402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannagctggtanntttttttttttttttttttttttttttttt

SEQ ID NO: 3403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannaactaggcnntttttttttttttttttttttttttttttt

SEQ ID NO: 3404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncagcaagtnntttttttttttttttttttttttttttttt

SEQ ID NO: 3405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannacgaggtanntttttttttttttttttttttttttttttt

SEQ ID NO: 3406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncatcttccnntttttttttttttttttttttttttttttt

SEQ ID NO: 3407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncctgaatcnntttttttttttttttttttttttttttttt

SEQ ID NO: 3408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganntgcagactnntttttttttttttttttttttttttttttt

SEQ ID NO: 3409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannagatgtggnntttttttttttttttttttttttttttttt

SEQ ID NO: 3410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannagttcgacnntttttttttttttttttttttttttttttt

SEQ ID NO: 3411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcgannacaacctcnntttttttttttttttttttttttttttttt

SEQ ID NO: 3412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncatggtagnntttttttttttttttttttttttttttttt

SEQ ID NO: 3413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncgtatctcnntttttttttttttttttttttttttttttt

SEQ ID NO: 3414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncctagttcnntttttttttttttttttttttttttttttt

SEQ ID NO: 3415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgatcganncaagagtcnntttttttttttttttttttttttttttttt

SEQ ID NO: 3416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnaatcggcanntttttttttttttttttttttttttttttt

SEQ ID NO: 3417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntacggcatnntttttttttttttttttttttttttttttt

SEQ ID NO: 3418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnttggatcgnntttttttttttttttttttttttttttttt

SEQ ID NO: 3419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntggaacganntttttttttttttttttttttttttttttt

SEQ ID NO: 3420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnggcaatcanntttttttttttttttttttttttttttttt

SEQ ID NO: 3421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngaatccganntttttttttttttttttttttttttttttt

SEQ ID NO: 3422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnttacggtgnntttttttttttttttttttttttttttttt

SEQ ID NO: 3423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncatatcggnntttttttttttttttttttttttttttttt

SEQ ID NO: 3424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncttcggtanntttttttttttttttttttttttttttttt

SEQ ID NO: 3425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntcctaacgnntttttttttttttttttttttttttttttt

SEQ ID NO: 3426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngtaagccanntttttttttttttttttttttttttttttt

SEQ ID NO: 3427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntaaggtggnntttttttttttttttttttttttttttttt

SEQ ID NO: 3428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnggtaagctnntttttttttttttttttttttttttttttt

SEQ ID NO: 3429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntgtgtcganntttttttttttttttttttttttttttttt

SEQ ID NO: 3430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngagcatganntttttttttttttttttttttttttttttt

SEQ ID NO: 3431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntcgaagtcnntttttttttttttttttttttttttttttt

SEQ ID NO: 3432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnggtgaacanntttttttttttttttttttttttttttttt

SEQ ID NO: 3433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnacatgcacnntttttttttttttttttttttttttttttt

SEQ ID NO: 3434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnccaacagtnntttttttttttttttttttttttttttttt

SEQ ID NO: 3435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnagaacagcnntttttttttttttttttttttttttttttt

SEQ ID NO: 3436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngaacacgtnntttttttttttttttttttttttttttttt

SEQ ID NO: 3437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnggtcttcanntttttttttttttttttttttttttttttt

SEQ ID NO: 3438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnaggttcagnntttttttttttttttttttttttttttttt

SEQ ID NO: 3439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnctagagcanntttttttttttttttttttttttttttttt

SEQ ID NO: 3440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncttctagcnntttttttttttttttttttttttttttttt

SEQ ID NO: 3441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngagtaacgnntttttttttttttttttttttttttttttt

SEQ ID NO: 3442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnctaagaggnntttttttttttttttttttttttttttttt

SEQ ID NO: 3443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnacgtgtagnntttttttttttttttttttttttttttttt

SEQ ID NO: 3444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnactacaggnntttttttttttttttttttttttttttttt

SEQ ID NO: 3445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntacaggtcnntttttttttttttttttttttttttttttt

SEQ ID NO: 3446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnctcacatgnntttttttttttttttttttttttttttttt

SEQ ID NO: 3447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnactaggagnntttttttttttttttttttttttttttttt

SEQ ID NO: 3448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnccatagganntttttttttttttttttttttttttttttt

SEQ ID NO: 3449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnggagaatcnntttttttttttttttttttttttttttttt

SEQ ID NO: 3450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngccaagaanntttttttttttttttttttttttttttttt

SEQ ID NO: 3451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnaaggcaagnntttttttttttttttttttttttttttttt

SEQ ID NO: 3452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnaatgtcgcnntttttttttttttttttttttttttttttt

SEQ ID NO: 3453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnatggaaccnntttttttttttttttttttttttttttttt

SEQ ID NO: 3454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnagaggcatnntttttttttttttttttttttttttttttt

SEQ ID NO: 3455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntgcatagcnntttttttttttttttttttttttttttttt

SEQ ID NO: 3456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnctaacgganntttttttttttttttttttttttttttttt

SEQ ID NO: 3457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntatcgaggnntttttttttttttttttttttttttttttt

SEQ ID NO: 3458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncatagcctnntttttttttttttttttttttttttttttt

SEQ ID NO: 3459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnatcgagacnntttttttttttttttttttttttttttttt

SEQ ID NO: 3460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnggaagagtnntttttttttttttttttttttttttttttt

SEQ ID NO: 3461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnccaagtagnntttttttttttttttttttttttttttttt

SEQ ID NO: 3462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnctgaacagnntttttttttttttttttttttttttttttt

SEQ ID NO: 3463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngtaggttcnntttttttttttttttttttttttttttttt

SEQ ID NO: 3464 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngtatggacnntttttttttttttttttttttttttttttt

SEQ ID NO: 3465 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntcgcaacanntttttttttttttttttttttttttttttt

SEQ ID NO: 3466 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnccgctaatnntttttttttttttttttttttttttttttt

SEQ ID NO: 3467 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngattcgcanntttttttttttttttttttttttttttttt

SEQ ID NO: 3468 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncgatggaanntttttttttttttttttttttttttttttt

SEQ ID NO: 3469 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnagcaagganntttttttttttttttttttttttttttttt

SEQ ID NO: 3470 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncgtagcaanntttttttttttttttttttttttttttttt

SEQ ID NO: 3471 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntggcagtanntttttttttttttttttttttttttttttt

SEQ ID NO: 3472 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncggtagttnntttttttttttttttttttttttttttttt

SEQ ID NO: 3473 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntgacttcgnntttttttttttttttttttttttttttttt

SEQ ID NO: 3474 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngagtgcaanntttttttttttttttttttttttttttttt

SEQ ID NO: 3475 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnacggtaacnntttttttttttttttttttttttttttttt

SEQ ID NO: 3476 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnaagtggtgnntttttttttttttttttttttttttttttt

SEQ ID NO: 3477 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnggagacaanntttttttttttttttttttttttttttttt

SEQ ID NO: 3478 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntcaaggacnntttttttttttttttttttttttttttttt

SEQ ID NO: 3479 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnaagagagcnntttttttttttttttttttttttttttttt

SEQ ID NO: 3480 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncgagagatnntttttttttttttttttttttttttttttt

SEQ ID NO: 3481 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnacagatggnntttttttttttttttttttttttttttttt

SEQ ID NO: 3482 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnaggagtcanntttttttttttttttttttttttttttttt

SEQ ID NO: 3483 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncgtgttacnntttttttttttttttttttttttttttttt

SEQ ID NO: 3484 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntagtgtgcnntttttttttttttttttttttttttttttt

SEQ ID NO: 3485 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnctcatgacnntttttttttttttttttttttttttttttt

SEQ ID NO: 3486 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngtatccagnntttttttttttttttttttttttttttttt

SEQ ID NO: 3487 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnacgcctatnntttttttttttttttttttttttttttttt

SEQ ID NO: 3488 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnaacgacctnntttttttttttttttttttttttttttttt

SEQ ID NO: 3489 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnatcaggctnntttttttttttttttttttttttttttttt

SEQ ID NO: 3490 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncaagttcgnntttttttttttttttttttttttttttttt

SEQ ID NO: 3491 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntagccaganntttttttttttttttttttttttttttttt

SEQ ID NO: 3492 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncaatcacgnntttttttttttttttttttttttttttttt

SEQ ID NO: 3493 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnngcaacaagnntttttttttttttttttttttttttttttt

SEQ ID NO: 3494 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncacgacaanntttttttttttttttttttttttttttttt

SEQ ID NO: 3495 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntacggaganntttttttttttttttttttttttttttttt

SEQ ID NO: 3496 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncgacaaganntttttttttttttttttttttttttttttt

SEQ ID NO: 3497 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncgaagtganntttttttttttttttttttttttttttttt

SEQ ID NO: 3498 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnagctggtanntttttttttttttttttttttttttttttt

SEQ ID NO: 3499 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnaactaggcnntttttttttttttttttttttttttttttt

SEQ ID NO: 3500 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncagcaagtnntttttttttttttttttttttttttttttt

SEQ ID NO: 3501 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnacgaggtanntttttttttttttttttttttttttttttt

SEQ ID NO: 3502 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncatcttccnntttttttttttttttttttttttttttttt

SEQ ID NO: 3503 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncctgaatcnntttttttttttttttttttttttttttttt

SEQ ID NO: 3504 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnntgcagactnntttttttttttttttttttttttttttttt

SEQ ID NO: 3505 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnagatgtggnntttttttttttttttttttttttttttttt

SEQ ID NO: 3506 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnagttcgacnntttttttttttttttttttttttttttttt

SEQ ID NO: 3507 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnnacaacctcnntttttttttttttttttttttttttttttt

SEQ ID NO: 3508 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncatggtagnntttttttttttttttttttttttttttttt

SEQ ID NO: 3509 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncgtatctcnntttttttttttttttttttttttttttttt

SEQ ID NO: 3510 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncctagttcnntttttttttttttttttttttttttttttt

SEQ ID NO: 3511 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaatcggnncaagagtcnntttttttttttttttttttttttttttttt

SEQ ID NO: 3512 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannaatcggcanntttttttttttttttttttttttttttttt

SEQ ID NO: 3513 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntacggcatnntttttttttttttttttttttttttttttt

SEQ ID NO: 3514 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannttggatcgnntttttttttttttttttttttttttttttt

SEQ ID NO: 3515 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntggaacganntttttttttttttttttttttttttttttt

SEQ ID NO: 3516 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannggcaatcanntttttttttttttttttttttttttttttt

SEQ ID NO: 3517 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngaatccganntttttttttttttttttttttttttttttt

SEQ ID NO: 3518 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannttacggtgnntttttttttttttttttttttttttttttt

SEQ ID NO: 3519 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncatatcggnntttttttttttttttttttttttttttttt

SEQ ID NO: 3520 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncttcggtanntttttttttttttttttttttttttttttt

SEQ ID NO: 3521 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntcctaacgnntttttttttttttttttttttttttttttt

SEQ ID NO: 3522 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngtaagccanntttttttttttttttttttttttttttttt

SEQ ID NO: 3523 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntaaggtggnntttttttttttttttttttttttttttttt

SEQ ID NO: 3524 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannggtaagctnntttttttttttttttttttttttttttttt

SEQ ID NO: 3525 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntgtgtcganntttttttttttttttttttttttttttttt

SEQ ID NO: 3526 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngagcatganntttttttttttttttttttttttttttttt

SEQ ID NO: 3527 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntcgaagtcnntttttttttttttttttttttttttttttt

SEQ ID NO: 3528 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannggtgaacanntttttttttttttttttttttttttttttt

SEQ ID NO: 3529 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannacatgcacnntttttttttttttttttttttttttttttt

SEQ ID NO: 3530 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannccaacagtnntttttttttttttttttttttttttttttt

SEQ ID NO: 3531 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannagaacagcnntttttttttttttttttttttttttttttt

SEQ ID NO: 3532 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngaacacgtnntttttttttttttttttttttttttttttt

SEQ ID NO: 3533 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannggtcttcanntttttttttttttttttttttttttttttt

SEQ ID NO: 3534 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannaggttcagnntttttttttttttttttttttttttttttt

SEQ ID NO: 3535 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannctagagcanntttttttttttttttttttttttttttttt

SEQ ID NO: 3536 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncttctagcnntttttttttttttttttttttttttttttt

SEQ ID NO: 3537 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngagtaacgnntttttttttttttttttttttttttttttt

SEQ ID NO: 3538 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannctaagaggnntttttttttttttttttttttttttttttt

SEQ ID NO: 3539 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannacgtgtagnntttttttttttttttttttttttttttttt

SEQ ID NO: 3540 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannactacaggnntttttttttttttttttttttttttttttt

SEQ ID NO: 3541 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntacaggtcnntttttttttttttttttttttttttttttt

SEQ ID NO: 3542 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannctcacatgnntttttttttttttttttttttttttttttt

SEQ ID NO: 3543 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannactaggagnntttttttttttttttttttttttttttttt

SEQ ID NO: 3544 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannccatagganntttttttttttttttttttttttttttttt

SEQ ID NO: 3545 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannggagaatcnntttttttttttttttttttttttttttttt

SEQ ID NO: 3546 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngccaagaanntttttttttttttttttttttttttttttt

SEQ ID NO: 3547 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannaaggcaagnntttttttttttttttttttttttttttttt

SEQ ID NO: 3548 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannaatgtcgcnntttttttttttttttttttttttttttttt

SEQ ID NO: 3549 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannatggaaccnntttttttttttttttttttttttttttttt

SEQ ID NO: 3550 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannagaggcatnntttttttttttttttttttttttttttttt

SEQ ID NO: 3551 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntgcatagcnntttttttttttttttttttttttttttttt

SEQ ID NO: 3552 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannctaacgganntttttttttttttttttttttttttttttt

SEQ ID NO: 3553 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntatcgaggnntttttttttttttttttttttttttttttt

SEQ ID NO: 3554 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncatagcctnntttttttttttttttttttttttttttttt

SEQ ID NO: 3555 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannatcgagacnntttttttttttttttttttttttttttttt

SEQ ID NO: 3556 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannggaagagtnntttttttttttttttttttttttttttttt

SEQ ID NO: 3557 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannccaagtagnntttttttttttttttttttttttttttttt

SEQ ID NO: 3558 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannctgaacagnntttttttttttttttttttttttttttttt

SEQ ID NO: 3559 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngtaggttcnntttttttttttttttttttttttttttttt

SEQ ID NO: 3560 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngtatggacnntttttttttttttttttttttttttttttt

SEQ ID NO: 3561 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntcgcaacanntttttttttttttttttttttttttttttt

SEQ ID NO: 3562 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannccgctaatnntttttttttttttttttttttttttttttt

SEQ ID NO: 3563 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngattcgcanntttttttttttttttttttttttttttttt

SEQ ID NO: 3564 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncgatggaanntttttttttttttttttttttttttttttt

SEQ ID NO: 3565 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannagcaagganntttttttttttttttttttttttttttttt

SEQ ID NO: 3566 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncgtagcaanntttttttttttttttttttttttttttttt

SEQ ID NO: 3567 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntggcagtanntttttttttttttttttttttttttttttt

SEQ ID NO: 3568 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncggtagttnntttttttttttttttttttttttttttttt

SEQ ID NO: 3569 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntgacttcgnntttttttttttttttttttttttttttttt

SEQ ID NO: 3570 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngagtgcaanntttttttttttttttttttttttttttttt

SEQ ID NO: 3571 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannacggtaacnntttttttttttttttttttttttttttttt

SEQ ID NO: 3572 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannaagtggtgnntttttttttttttttttttttttttttttt

SEQ ID NO: 3573 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannggagacaanntttttttttttttttttttttttttttttt

SEQ ID NO: 3574 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntcaaggacnntttttttttttttttttttttttttttttt

SEQ ID NO: 3575 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannaagagagcnntttttttttttttttttttttttttttttt

SEQ ID NO: 3576 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncgagagatnntttttttttttttttttttttttttttttt

SEQ ID NO: 3577 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannacagatggnntttttttttttttttttttttttttttttt

SEQ ID NO: 3578 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannaggagtcanntttttttttttttttttttttttttttttt

SEQ ID NO: 3579 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncgtgttacnntttttttttttttttttttttttttttttt

SEQ ID NO: 3580 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntagtgtgcnntttttttttttttttttttttttttttttt

SEQ ID NO: 3581 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannctcatgacnntttttttttttttttttttttttttttttt

SEQ ID NO: 3582 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngtatccagnntttttttttttttttttttttttttttttt

SEQ ID NO: 3583 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannacgcctatnntttttttttttttttttttttttttttttt

SEQ ID NO: 3584 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannaacgacctnntttttttttttttttttttttttttttttt

SEQ ID NO: 3585 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannatcaggctnntttttttttttttttttttttttttttttt

SEQ ID NO: 3586 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncaagttcgnntttttttttttttttttttttttttttttt

SEQ ID NO: 3587 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntagccaganntttttttttttttttttttttttttttttt

SEQ ID NO: 3588 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncaatcacgnntttttttttttttttttttttttttttttt

SEQ ID NO: 3589 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganngcaacaagnntttttttttttttttttttttttttttttt

SEQ ID NO: 3590 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncacgacaanntttttttttttttttttttttttttttttt

SEQ ID NO: 3591 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntacggaganntttttttttttttttttttttttttttttt

SEQ ID NO: 3592 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncgacaaganntttttttttttttttttttttttttttttt

SEQ ID NO: 3593 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncgaagtganntttttttttttttttttttttttttttttt

SEQ ID NO: 3594 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannagctggtanntttttttttttttttttttttttttttttt

SEQ ID NO: 3595 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannaactaggcnntttttttttttttttttttttttttttttt

SEQ ID NO: 3596 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncagcaagtnntttttttttttttttttttttttttttttt

SEQ ID NO: 3597 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannacgaggtanntttttttttttttttttttttttttttttt

SEQ ID NO: 3598 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncatcttccnntttttttttttttttttttttttttttttt

SEQ ID NO: 3599 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncctgaatcnntttttttttttttttttttttttttttttt

SEQ ID NO: 3600 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganntgcagactnntttttttttttttttttttttttttttttt

SEQ ID NO: 3601 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannagatgtggnntttttttttttttttttttttttttttttt

SEQ ID NO: 3602 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannagttcgacnntttttttttttttttttttttttttttttt

SEQ ID NO: 3603 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatggannacaacctcnntttttttttttttttttttttttttttttt

SEQ ID NO: 3604 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncatggtagnntttttttttttttttttttttttttttttt

SEQ ID NO: 3605 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncgtatctcnntttttttttttttttttttttttttttttt

SEQ ID NO: 3606 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncctagttcnntttttttttttttttttttttttttttttt

SEQ ID NO: 3607 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggaatgganncaagagtcnntttttttttttttttttttttttttttttt

SEQ ID NO: 3608 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnaatcggcanntttttttttttttttttttttttttttttt

SEQ ID NO: 3609 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntacggcatnntttttttttttttttttttttttttttttt

SEQ ID NO: 3610 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnttggatcgnntttttttttttttttttttttttttttttt

SEQ ID NO: 3611 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntggaacganntttttttttttttttttttttttttttttt

SEQ ID NO: 3612 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnggcaatcanntttttttttttttttttttttttttttttt

SEQ ID NO: 3613 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngaatccganntttttttttttttttttttttttttttttt

SEQ ID NO: 3614 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnttacggtgnntttttttttttttttttttttttttttttt

SEQ ID NO: 3615 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncatatcggnntttttttttttttttttttttttttttttt

SEQ ID NO: 3616 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncttcggtanntttttttttttttttttttttttttttttt

SEQ ID NO: 3617 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntcctaacgnntttttttttttttttttttttttttttttt

SEQ ID NO: 3618 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngtaagccanntttttttttttttttttttttttttttttt

SEQ ID NO: 3619 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntaaggtggnntttttttttttttttttttttttttttttt

SEQ ID NO: 3620 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnggtaagctnntttttttttttttttttttttttttttttt

SEQ ID NO: 3621 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntgtgtcganntttttttttttttttttttttttttttttt

SEQ ID NO: 3622 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngagcatganntttttttttttttttttttttttttttttt

SEQ ID NO: 3623 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntcgaagtcnntttttttttttttttttttttttttttttt

SEQ ID NO: 3624 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnggtgaacanntttttttttttttttttttttttttttttt

SEQ ID NO: 3625 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnacatgcacnntttttttttttttttttttttttttttttt

SEQ ID NO: 3626 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnccaacagtnntttttttttttttttttttttttttttttt

SEQ ID NO: 3627 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnagaacagcnntttttttttttttttttttttttttttttt

SEQ ID NO: 3628 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngaacacgtnntttttttttttttttttttttttttttttt

SEQ ID NO: 3629 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnggtcttcanntttttttttttttttttttttttttttttt

SEQ ID NO: 3630 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnaggttcagnntttttttttttttttttttttttttttttt

SEQ ID NO: 3631 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnctagagcanntttttttttttttttttttttttttttttt

SEQ ID NO: 3632 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncttctagcnntttttttttttttttttttttttttttttt

SEQ ID NO: 3633 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngagtaacgnntttttttttttttttttttttttttttttt

SEQ ID NO: 3634 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnctaagaggnntttttttttttttttttttttttttttttt

SEQ ID NO: 3635 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnacgtgtagnntttttttttttttttttttttttttttttt

SEQ ID NO: 3636 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnactacaggnntttttttttttttttttttttttttttttt

SEQ ID NO: 3637 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntacaggtcnntttttttttttttttttttttttttttttt

SEQ ID NO: 3638 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnctcacatgnntttttttttttttttttttttttttttttt

SEQ ID NO: 3639 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnactaggagnntttttttttttttttttttttttttttttt

SEQ ID NO: 3640 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnccatagganntttttttttttttttttttttttttttttt

SEQ ID NO: 3641 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnggagaatcnntttttttttttttttttttttttttttttt

SEQ ID NO: 3642 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngccaagaanntttttttttttttttttttttttttttttt

SEQ ID NO: 3643 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnaaggcaagnntttttttttttttttttttttttttttttt

SEQ ID NO: 3644 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnaatgtcgcnntttttttttttttttttttttttttttttt

SEQ ID NO: 3645 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnatggaaccnntttttttttttttttttttttttttttttt

SEQ ID NO: 3646 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnagaggcatnntttttttttttttttttttttttttttttt

SEQ ID NO: 3647 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntgcatagcnntttttttttttttttttttttttttttttt

SEQ ID NO: 3648 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnctaacgganntttttttttttttttttttttttttttttt

SEQ ID NO: 3649 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntatcgaggnntttttttttttttttttttttttttttttt

SEQ ID NO: 3650 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncatagcctnntttttttttttttttttttttttttttttt

SEQ ID NO: 3651 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnatcgagacnntttttttttttttttttttttttttttttt

SEQ ID NO: 3652 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnggaagagtnntttttttttttttttttttttttttttttt

SEQ ID NO: 3653 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnccaagtagnntttttttttttttttttttttttttttttt

SEQ ID NO: 3654 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnctgaacagnntttttttttttttttttttttttttttttt

SEQ ID NO: 3655 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngtaggttcnntttttttttttttttttttttttttttttt

SEQ ID NO: 3656 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngtatggacnntttttttttttttttttttttttttttttt

SEQ ID NO: 3657 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntcgcaacanntttttttttttttttttttttttttttttt

SEQ ID NO: 3658 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnccgctaatnntttttttttttttttttttttttttttttt

SEQ ID NO: 3659 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngattcgcanntttttttttttttttttttttttttttttt

SEQ ID NO: 3660 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncgatggaanntttttttttttttttttttttttttttttt

SEQ ID NO: 3661 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnagcaagganntttttttttttttttttttttttttttttt

SEQ ID NO: 3662 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncgtagcaanntttttttttttttttttttttttttttttt

SEQ ID NO: 3663 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntggcagtanntttttttttttttttttttttttttttttt

SEQ ID NO: 3664 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncggtagttnntttttttttttttttttttttttttttttt

SEQ ID NO: 3665 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntgacttcgnntttttttttttttttttttttttttttttt

SEQ ID NO: 3666 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngagtgcaanntttttttttttttttttttttttttttttt

SEQ ID NO: 3667 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnacggtaacnntttttttttttttttttttttttttttttt

SEQ ID NO: 3668 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnaagtggtgnntttttttttttttttttttttttttttttt

SEQ ID NO: 3669 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnggagacaanntttttttttttttttttttttttttttttt

SEQ ID NO: 3670 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntcaaggacnntttttttttttttttttttttttttttttt

SEQ ID NO: 3671 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnaagagagcnntttttttttttttttttttttttttttttt

SEQ ID NO: 3672 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncgagagatnntttttttttttttttttttttttttttttt

SEQ ID NO: 3673 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnacagatggnntttttttttttttttttttttttttttttt

SEQ ID NO: 3674 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnaggagtcanntttttttttttttttttttttttttttttt

SEQ ID NO: 3675 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncgtgttacnntttttttttttttttttttttttttttttt

SEQ ID NO: 3676 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntagtgtgcnntttttttttttttttttttttttttttttt

SEQ ID NO: 3677 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnctcatgacnntttttttttttttttttttttttttttttt

SEQ ID NO: 3678 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngtatccagnntttttttttttttttttttttttttttttt

SEQ ID NO: 3679 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnacgcctatnntttttttttttttttttttttttttttttt

SEQ ID NO: 3680 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnaacgacctnntttttttttttttttttttttttttttttt

SEQ ID NO: 3681 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnatcaggctnntttttttttttttttttttttttttttttt

SEQ ID NO: 3682 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncaagttcgnntttttttttttttttttttttttttttttt

SEQ ID NO: 3683 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntagccaganntttttttttttttttttttttttttttttt

SEQ ID NO: 3684 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncaatcacgnntttttttttttttttttttttttttttttt

SEQ ID NO: 3685 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnngcaacaagnntttttttttttttttttttttttttttttt

SEQ ID NO: 3686 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncacgacaanntttttttttttttttttttttttttttttt

SEQ ID NO: 3687 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntacggaganntttttttttttttttttttttttttttttt

SEQ ID NO: 3688 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncgacaaganntttttttttttttttttttttttttttttt

SEQ ID NO: 3689 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncgaagtganntttttttttttttttttttttttttttttt

SEQ ID NO: 3690 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnagctggtanntttttttttttttttttttttttttttttt

SEQ ID NO: 3691 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnaactaggcnntttttttttttttttttttttttttttttt

SEQ ID NO: 3692 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncagcaagtnntttttttttttttttttttttttttttttt

SEQ ID NO: 3693 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnacgaggtanntttttttttttttttttttttttttttttt

SEQ ID NO: 3694 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncatcttccnntttttttttttttttttttttttttttttt

SEQ ID NO: 3695 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncctgaatcnntttttttttttttttttttttttttttttt

SEQ ID NO: 3696 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnntgcagactnntttttttttttttttttttttttttttttt

SEQ ID NO: 3697 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnagatgtggnntttttttttttttttttttttttttttttt

SEQ ID NO: 3698 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnagttcgacnntttttttttttttttttttttttttttttt

SEQ ID NO: 3699 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnnacaacctcnntttttttttttttttttttttttttttttt

SEQ ID NO: 3700 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncatggtagnntttttttttttttttttttttttttttttt

SEQ ID NO: 3701 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncgtatctcnntttttttttttttttttttttttttttttt

SEQ ID NO: 3702 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncctagttcnntttttttttttttttttttttttttttttt

SEQ ID NO: 3703 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccgtattgnncaagagtcnntttttttttttttttttttttttttttttt

SEQ ID NO: 3704 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnaatcggcanntttttttttttttttttttttttttttttt

SEQ ID NO: 3705 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntacggcatnntttttttttttttttttttttttttttttt

SEQ ID NO: 3706 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnttggatcgnntttttttttttttttttttttttttttttt

SEQ ID NO: 3707 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntggaacganntttttttttttttttttttttttttttttt

SEQ ID NO: 3708 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnggcaatcanntttttttttttttttttttttttttttttt

SEQ ID NO: 3709 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngaatccganntttttttttttttttttttttttttttttt

SEQ ID NO: 3710 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnttacggtgnntttttttttttttttttttttttttttttt

SEQ ID NO: 3711 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncatatcggnntttttttttttttttttttttttttttttt

SEQ ID NO: 3712 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncttcggtanntttttttttttttttttttttttttttttt

SEQ ID NO: 3713 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntcctaacgnntttttttttttttttttttttttttttttt

SEQ ID NO: 3714 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngtaagccanntttttttttttttttttttttttttttttt

SEQ ID NO: 3715 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntaaggtggnntttttttttttttttttttttttttttttt

SEQ ID NO: 3716 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnggtaagctnntttttttttttttttttttttttttttttt

SEQ ID NO: 3717 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntgtgtcganntttttttttttttttttttttttttttttt

SEQ ID NO: 3718 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngagcatganntttttttttttttttttttttttttttttt

SEQ ID NO: 3719 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntcgaagtcnntttttttttttttttttttttttttttttt

SEQ ID NO: 3720 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnggtgaacanntttttttttttttttttttttttttttttt

SEQ ID NO: 3721 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnacatgcacnntttttttttttttttttttttttttttttt

SEQ ID NO: 3722 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnccaacagtnntttttttttttttttttttttttttttttt

SEQ ID NO: 3723 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnagaacagcnntttttttttttttttttttttttttttttt

SEQ ID NO: 3724 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngaacacgtnntttttttttttttttttttttttttttttt

SEQ ID NO: 3725 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnggtcttcanntttttttttttttttttttttttttttttt

SEQ ID NO: 3726 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnaggttcagnntttttttttttttttttttttttttttttt

SEQ ID NO: 3727 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnctagagcanntttttttttttttttttttttttttttttt

SEQ ID NO: 3728 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncttctagcnntttttttttttttttttttttttttttttt

SEQ ID NO: 3729 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngagtaacgnntttttttttttttttttttttttttttttt

SEQ ID NO: 3730 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnctaagaggnntttttttttttttttttttttttttttttt

SEQ ID NO: 3731 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnacgtgtagnntttttttttttttttttttttttttttttt

SEQ ID NO: 3732 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnactacaggnntttttttttttttttttttttttttttttt

SEQ ID NO: 3733 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntacaggtcnntttttttttttttttttttttttttttttt

SEQ ID NO: 3734 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnctcacatgnntttttttttttttttttttttttttttttt

SEQ ID NO: 3735 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnactaggagnntttttttttttttttttttttttttttttt

SEQ ID NO: 3736 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnccatagganntttttttttttttttttttttttttttttt

SEQ ID NO: 3737 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnggagaatcnntttttttttttttttttttttttttttttt

SEQ ID NO: 3738 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngccaagaanntttttttttttttttttttttttttttttt

SEQ ID NO: 3739 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnaaggcaagnntttttttttttttttttttttttttttttt

SEQ ID NO: 3740 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnaatgtcgcnntttttttttttttttttttttttttttttt

SEQ ID NO: 3741 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnatggaaccnntttttttttttttttttttttttttttttt

SEQ ID NO: 3742 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnagaggcatnntttttttttttttttttttttttttttttt

SEQ ID NO: 3743 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntgcatagcnntttttttttttttttttttttttttttttt

SEQ ID NO: 3744 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnctaacgganntttttttttttttttttttttttttttttt

SEQ ID NO: 3745 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntatcgaggnntttttttttttttttttttttttttttttt

SEQ ID NO: 3746 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncatagcctnntttttttttttttttttttttttttttttt

SEQ ID NO: 3747 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnatcgagacnntttttttttttttttttttttttttttttt

SEQ ID NO: 3748 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnggaagagtnntttttttttttttttttttttttttttttt

SEQ ID NO: 3749 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnccaagtagnntttttttttttttttttttttttttttttt

SEQ ID NO: 3750 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnctgaacagnntttttttttttttttttttttttttttttt

SEQ ID NO: 3751 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngtaggttcnntttttttttttttttttttttttttttttt

SEQ ID NO: 3752 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngtatggacnntttttttttttttttttttttttttttttt

SEQ ID NO: 3753 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntcgcaacanntttttttttttttttttttttttttttttt

SEQ ID NO: 3754 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnccgctaatnntttttttttttttttttttttttttttttt

SEQ ID NO: 3755 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngattcgcanntttttttttttttttttttttttttttttt

SEQ ID NO: 3756 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncgatggaanntttttttttttttttttttttttttttttt

SEQ ID NO: 3757 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnagcaagganntttttttttttttttttttttttttttttt

SEQ ID NO: 3758 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncgtagcaanntttttttttttttttttttttttttttttt

SEQ ID NO: 3759 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntggcagtanntttttttttttttttttttttttttttttt

SEQ ID NO: 3760 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncggtagttnntttttttttttttttttttttttttttttt

SEQ ID NO: 3761 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntgacttcgnntttttttttttttttttttttttttttttt

SEQ ID NO: 3762 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngagtgcaanntttttttttttttttttttttttttttttt

SEQ ID NO: 3763 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnacggtaacnntttttttttttttttttttttttttttttt

SEQ ID NO: 3764 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnaagtggtgnntttttttttttttttttttttttttttttt

SEQ ID NO: 3765 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnggagacaanntttttttttttttttttttttttttttttt

SEQ ID NO: 3766 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntcaaggacnntttttttttttttttttttttttttttttt

SEQ ID NO: 3767 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnaagagagcnntttttttttttttttttttttttttttttt

SEQ ID NO: 3768 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncgagagatnntttttttttttttttttttttttttttttt

SEQ ID NO: 3769 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnacagatggnntttttttttttttttttttttttttttttt

SEQ ID NO: 3770 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnaggagtcanntttttttttttttttttttttttttttttt

SEQ ID NO: 3771 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncgtgttacnntttttttttttttttttttttttttttttt

SEQ ID NO: 3772 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntagtgtgcnntttttttttttttttttttttttttttttt

SEQ ID NO: 3773 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnctcatgacnntttttttttttttttttttttttttttttt

SEQ ID NO: 3774 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngtatccagnntttttttttttttttttttttttttttttt

SEQ ID NO: 3775 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnacgcctatnntttttttttttttttttttttttttttttt

SEQ ID NO: 3776 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnaacgacctnntttttttttttttttttttttttttttttt

SEQ ID NO: 3777 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnatcaggctnntttttttttttttttttttttttttttttt

SEQ ID NO: 3778 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncaagttcgnntttttttttttttttttttttttttttttt

SEQ ID NO: 3779 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntagccaganntttttttttttttttttttttttttttttt

SEQ ID NO: 3780 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncaatcacgnntttttttttttttttttttttttttttttt

SEQ ID NO: 3781 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnngcaacaagnntttttttttttttttttttttttttttttt

SEQ ID NO: 3782 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncacgacaanntttttttttttttttttttttttttttttt

SEQ ID NO: 3783 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntacggaganntttttttttttttttttttttttttttttt

SEQ ID NO: 3784 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncgacaaganntttttttttttttttttttttttttttttt

SEQ ID NO: 3785 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncgaagtganntttttttttttttttttttttttttttttt

SEQ ID NO: 3786 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnagctggtanntttttttttttttttttttttttttttttt

SEQ ID NO: 3787 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnaactaggcnntttttttttttttttttttttttttttttt

SEQ ID NO: 3788 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncagcaagtnntttttttttttttttttttttttttttttt

SEQ ID NO: 3789 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnacgaggtanntttttttttttttttttttttttttttttt

SEQ ID NO: 3790 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncatcttccnntttttttttttttttttttttttttttttt

SEQ ID NO: 3791 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncctgaatcnntttttttttttttttttttttttttttttt

SEQ ID NO: 3792 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnntgcagactnntttttttttttttttttttttttttttttt

SEQ ID NO: 3793 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnagatgtggnntttttttttttttttttttttttttttttt

SEQ ID NO: 3794 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnagttcgacnntttttttttttttttttttttttttttttt

SEQ ID NO: 3795 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnnacaacctcnntttttttttttttttttttttttttttttt

SEQ ID NO: 3796 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncatggtagnntttttttttttttttttttttttttttttt

SEQ ID NO: 3797 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncgtatctcnntttttttttttttttttttttttttttttt

SEQ ID NO: 3798 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncctagttcnntttttttttttttttttttttttttttttt

SEQ ID NO: 3799 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaaggaggtnncaagagtcnntttttttttttttttttttttttttttttt

SEQ ID NO: 3800 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnaatcggcanntttttttttttttttttttttttttttttt

SEQ ID NO: 3801 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntacggcatnntttttttttttttttttttttttttttttt

SEQ ID NO: 3802 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnttggatcgnntttttttttttttttttttttttttttttt

SEQ ID NO: 3803 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntggaacganntttttttttttttttttttttttttttttt

SEQ ID NO: 3804 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnggcaatcanntttttttttttttttttttttttttttttt

SEQ ID NO: 3805 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngaatccganntttttttttttttttttttttttttttttt

SEQ ID NO: 3806 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnttacggtgnntttttttttttttttttttttttttttttt

SEQ ID NO: 3807 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncatatcggnntttttttttttttttttttttttttttttt

SEQ ID NO: 3808 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncttcggtanntttttttttttttttttttttttttttttt

SEQ ID NO: 3809 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntcctaacgnntttttttttttttttttttttttttttttt

SEQ ID NO: 3810 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngtaagccanntttttttttttttttttttttttttttttt

SEQ ID NO: 3811 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntaaggtggnntttttttttttttttttttttttttttttt

SEQ ID NO: 3812 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnggtaagctnntttttttttttttttttttttttttttttt

SEQ ID NO: 3813 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntgtgtcganntttttttttttttttttttttttttttttt

SEQ ID NO: 3814 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngagcatganntttttttttttttttttttttttttttttt

SEQ ID NO: 3815 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntcgaagtcnntttttttttttttttttttttttttttttt

SEQ ID NO: 3816 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnggtgaacanntttttttttttttttttttttttttttttt

SEQ ID NO: 3817 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnacatgcacnntttttttttttttttttttttttttttttt

SEQ ID NO: 3818 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnccaacagtnntttttttttttttttttttttttttttttt

SEQ ID NO: 3819 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnagaacagcnntttttttttttttttttttttttttttttt

SEQ ID NO: 3820 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngaacacgtnntttttttttttttttttttttttttttttt

SEQ ID NO: 3821 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnggtcttcanntttttttttttttttttttttttttttttt

SEQ ID NO: 3822 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnaggttcagnntttttttttttttttttttttttttttttt

SEQ ID NO: 3823 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnctagagcanntttttttttttttttttttttttttttttt

SEQ ID NO: 3824 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncttctagcnntttttttttttttttttttttttttttttt

SEQ ID NO: 3825 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngagtaacgnntttttttttttttttttttttttttttttt

SEQ ID NO: 3826 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnctaagaggnntttttttttttttttttttttttttttttt

SEQ ID NO: 3827 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnacgtgtagnntttttttttttttttttttttttttttttt

SEQ ID NO: 3828 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnactacaggnntttttttttttttttttttttttttttttt

SEQ ID NO: 3829 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntacaggtcnntttttttttttttttttttttttttttttt

SEQ ID NO: 3830 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnctcacatgnntttttttttttttttttttttttttttttt

SEQ ID NO: 3831 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnactaggagnntttttttttttttttttttttttttttttt

SEQ ID NO: 3832 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnccatagganntttttttttttttttttttttttttttttt

SEQ ID NO: 3833 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnggagaatcnntttttttttttttttttttttttttttttt

SEQ ID NO: 3834 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngccaagaanntttttttttttttttttttttttttttttt

SEQ ID NO: 3835 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnaaggcaagnntttttttttttttttttttttttttttttt

SEQ ID NO: 3836 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnaatgtcgcnntttttttttttttttttttttttttttttt

SEQ ID NO: 3837 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnatggaaccnntttttttttttttttttttttttttttttt

SEQ ID NO: 3838 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnagaggcatnntttttttttttttttttttttttttttttt

SEQ ID NO: 3839 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntgcatagcnntttttttttttttttttttttttttttttt

SEQ ID NO: 3840 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnctaacgganntttttttttttttttttttttttttttttt

SEQ ID NO: 3841 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntatcgaggnntttttttttttttttttttttttttttttt

SEQ ID NO: 3842 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncatagcctnntttttttttttttttttttttttttttttt

SEQ ID NO: 3843 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnatcgagacnntttttttttttttttttttttttttttttt

SEQ ID NO: 3844 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnggaagagtnntttttttttttttttttttttttttttttt

SEQ ID NO: 3845 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnccaagtagnntttttttttttttttttttttttttttttt

SEQ ID NO: 3846 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnctgaacagnntttttttttttttttttttttttttttttt

SEQ ID NO: 3847 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngtaggttcnntttttttttttttttttttttttttttttt

SEQ ID NO: 3848 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngtatggacnntttttttttttttttttttttttttttttt

SEQ ID NO: 3849 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntcgcaacanntttttttttttttttttttttttttttttt

SEQ ID NO: 3850 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnccgctaatnntttttttttttttttttttttttttttttt

SEQ ID NO: 3851 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngattcgcanntttttttttttttttttttttttttttttt

SEQ ID NO: 3852 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncgatggaanntttttttttttttttttttttttttttttt

SEQ ID NO: 3853 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnagcaagganntttttttttttttttttttttttttttttt

SEQ ID NO: 3854 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncgtagcaanntttttttttttttttttttttttttttttt

SEQ ID NO: 3855 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntggcagtanntttttttttttttttttttttttttttttt

SEQ ID NO: 3856 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncggtagttnntttttttttttttttttttttttttttttt

SEQ ID NO: 3857 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntgacttcgnntttttttttttttttttttttttttttttt

SEQ ID NO: 3858 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngagtgcaanntttttttttttttttttttttttttttttt

SEQ ID NO: 3859 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnacggtaacnntttttttttttttttttttttttttttttt

SEQ ID NO: 3860 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnaagtggtgnntttttttttttttttttttttttttttttt

SEQ ID NO: 3861 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnggagacaanntttttttttttttttttttttttttttttt

SEQ ID NO: 3862 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntcaaggacnntttttttttttttttttttttttttttttt

SEQ ID NO: 3863 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnaagagagcnntttttttttttttttttttttttttttttt

SEQ ID NO: 3864 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncgagagatnntttttttttttttttttttttttttttttt

SEQ ID NO: 3865 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnacagatggnntttttttttttttttttttttttttttttt

SEQ ID NO: 3866 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnaggagtcanntttttttttttttttttttttttttttttt

SEQ ID NO: 3867 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncgtgttacnntttttttttttttttttttttttttttttt

SEQ ID NO: 3868 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntagtgtgcnntttttttttttttttttttttttttttttt

SEQ ID NO: 3869 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnctcatgacnntttttttttttttttttttttttttttttt

SEQ ID NO: 3870 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngtatccagnntttttttttttttttttttttttttttttt

SEQ ID NO: 3871 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnacgcctatnntttttttttttttttttttttttttttttt

SEQ ID NO: 3872 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnaacgacctnntttttttttttttttttttttttttttttt

SEQ ID NO: 3873 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnatcaggctnntttttttttttttttttttttttttttttt

SEQ ID NO: 3874 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncaagttcgnntttttttttttttttttttttttttttttt

SEQ ID NO: 3875 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntagccaganntttttttttttttttttttttttttttttt

SEQ ID NO: 3876 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncaatcacgnntttttttttttttttttttttttttttttt

SEQ ID NO: 3877 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnngcaacaagnntttttttttttttttttttttttttttttt

SEQ ID NO: 3878 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncacgacaanntttttttttttttttttttttttttttttt

SEQ ID NO: 3879 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntacggaganntttttttttttttttttttttttttttttt

SEQ ID NO: 3880 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncgacaaganntttttttttttttttttttttttttttttt

SEQ ID NO: 3881 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncgaagtganntttttttttttttttttttttttttttttt

SEQ ID NO: 3882 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnagctggtanntttttttttttttttttttttttttttttt

SEQ ID NO: 3883 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnaactaggcnntttttttttttttttttttttttttttttt

SEQ ID NO: 3884 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncagcaagtnntttttttttttttttttttttttttttttt

SEQ ID NO: 3885 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnacgaggtanntttttttttttttttttttttttttttttt

SEQ ID NO: 3886 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncatcttccnntttttttttttttttttttttttttttttt

SEQ ID NO: 3887 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncctgaatcnntttttttttttttttttttttttttttttt

SEQ ID NO: 3888 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnntgcagactnntttttttttttttttttttttttttttttt

SEQ ID NO: 3889 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnagatgtggnntttttttttttttttttttttttttttttt

SEQ ID NO: 3890 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnagttcgacnntttttttttttttttttttttttttttttt

SEQ ID NO: 3891 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnnacaacctcnntttttttttttttttttttttttttttttt

SEQ ID NO: 3892 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncatggtagnntttttttttttttttttttttttttttttt

SEQ ID NO: 3893 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncgtatctcnntttttttttttttttttttttttttttttt

SEQ ID NO: 3894 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncctagttcnntttttttttttttttttttttttttttttt

SEQ ID NO: 3895 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggaatgnncaagagtcnntttttttttttttttttttttttttttttt

SEQ ID NO: 3896 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnaatcggcanntttttttttttttttttttttttttttttt

SEQ ID NO: 3897 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntacggcatnntttttttttttttttttttttttttttttt

SEQ ID NO: 3898 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnttggatcgnntttttttttttttttttttttttttttttt

SEQ ID NO: 3899 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntggaacganntttttttttttttttttttttttttttttt

SEQ ID NO: 3900 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnggcaatcanntttttttttttttttttttttttttttttt

SEQ ID NO: 3901 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngaatccganntttttttttttttttttttttttttttttt

SEQ ID NO: 3902 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnttacggtgnntttttttttttttttttttttttttttttt

SEQ ID NO: 3903 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncatatcggnntttttttttttttttttttttttttttttt

SEQ ID NO: 3904 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncttcggtanntttttttttttttttttttttttttttttt

SEQ ID NO: 3905 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntcctaacgnntttttttttttttttttttttttttttttt

SEQ ID NO: 3906 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngtaagccanntttttttttttttttttttttttttttttt

SEQ ID NO: 3907 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntaaggtggnntttttttttttttttttttttttttttttt

SEQ ID NO: 3908 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnggtaagctnntttttttttttttttttttttttttttttt

SEQ ID NO: 3909 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntgtgtcganntttttttttttttttttttttttttttttt

SEQ ID NO: 3910 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngagcatganntttttttttttttttttttttttttttttt

SEQ ID NO: 3911 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntcgaagtcnntttttttttttttttttttttttttttttt

SEQ ID NO: 3912 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnggtgaacanntttttttttttttttttttttttttttttt

SEQ ID NO: 3913 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnacatgcacnntttttttttttttttttttttttttttttt

SEQ ID NO: 3914 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnccaacagtnntttttttttttttttttttttttttttttt

SEQ ID NO: 3915 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnagaacagcnntttttttttttttttttttttttttttttt

SEQ ID NO: 3916 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngaacacgtnntttttttttttttttttttttttttttttt

SEQ ID NO: 3917 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnggtcttcanntttttttttttttttttttttttttttttt

SEQ ID NO: 3918 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnaggttcagnntttttttttttttttttttttttttttttt

SEQ ID NO: 3919 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnctagagcanntttttttttttttttttttttttttttttt

SEQ ID NO: 3920 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncttctagcnntttttttttttttttttttttttttttttt

SEQ ID NO: 3921 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngagtaacgnntttttttttttttttttttttttttttttt

SEQ ID NO: 3922 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnctaagaggnntttttttttttttttttttttttttttttt

SEQ ID NO: 3923 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnacgtgtagnntttttttttttttttttttttttttttttt

SEQ ID NO: 3924 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnactacaggnntttttttttttttttttttttttttttttt

SEQ ID NO: 3925 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntacaggtcnntttttttttttttttttttttttttttttt

SEQ ID NO: 3926 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnctcacatgnntttttttttttttttttttttttttttttt

SEQ ID NO: 3927 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnactaggagnntttttttttttttttttttttttttttttt

SEQ ID NO: 3928 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnccatagganntttttttttttttttttttttttttttttt

SEQ ID NO: 3929 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnggagaatcnntttttttttttttttttttttttttttttt

SEQ ID NO: 3930 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngccaagaanntttttttttttttttttttttttttttttt

SEQ ID NO: 3931 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnaaggcaagnntttttttttttttttttttttttttttttt

SEQ ID NO: 3932 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnaatgtcgcnntttttttttttttttttttttttttttttt

SEQ ID NO: 3933 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnatggaaccnntttttttttttttttttttttttttttttt

SEQ ID NO: 3934 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnagaggcatnntttttttttttttttttttttttttttttt

SEQ ID NO: 3935 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntgcatagcnntttttttttttttttttttttttttttttt

SEQ ID NO: 3936 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnctaacgganntttttttttttttttttttttttttttttt

SEQ ID NO: 3937 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntatcgaggnntttttttttttttttttttttttttttttt

SEQ ID NO: 3938 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncatagcctnntttttttttttttttttttttttttttttt

SEQ ID NO: 3939 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnatcgagacnntttttttttttttttttttttttttttttt

SEQ ID NO: 3940 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnggaagagtnntttttttttttttttttttttttttttttt

SEQ ID NO: 3941 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnccaagtagnntttttttttttttttttttttttttttttt

SEQ ID NO: 3942 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnctgaacagnntttttttttttttttttttttttttttttt

SEQ ID NO: 3943 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngtaggttcnntttttttttttttttttttttttttttttt

SEQ ID NO: 3944 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngtatggacnntttttttttttttttttttttttttttttt

SEQ ID NO: 3945 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntcgcaacanntttttttttttttttttttttttttttttt

SEQ ID NO: 3946 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnccgctaatnntttttttttttttttttttttttttttttt

SEQ ID NO: 3947 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngattcgcanntttttttttttttttttttttttttttttt

SEQ ID NO: 3948 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncgatggaanntttttttttttttttttttttttttttttt

SEQ ID NO: 3949 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnagcaagganntttttttttttttttttttttttttttttt

SEQ ID NO: 3950 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncgtagcaanntttttttttttttttttttttttttttttt

SEQ ID NO: 3951 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntggcagtanntttttttttttttttttttttttttttttt

SEQ ID NO: 3952 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncggtagttnntttttttttttttttttttttttttttttt

SEQ ID NO: 3953 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntgacttcgnntttttttttttttttttttttttttttttt

SEQ ID NO: 3954 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngagtgcaanntttttttttttttttttttttttttttttt

SEQ ID NO: 3955 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnacggtaacnntttttttttttttttttttttttttttttt

SEQ ID NO: 3956 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnaagtggtgnntttttttttttttttttttttttttttttt

SEQ ID NO: 3957 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnggagacaanntttttttttttttttttttttttttttttt

SEQ ID NO: 3958 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntcaaggacnntttttttttttttttttttttttttttttt

SEQ ID NO: 3959 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnaagagagcnntttttttttttttttttttttttttttttt

SEQ ID NO: 3960 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncgagagatnntttttttttttttttttttttttttttttt

SEQ ID NO: 3961 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnacagatggnntttttttttttttttttttttttttttttt

SEQ ID NO: 3962 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnaggagtcanntttttttttttttttttttttttttttttt

SEQ ID NO: 3963 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncgtgttacnntttttttttttttttttttttttttttttt

SEQ ID NO: 3964 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntagtgtgcnntttttttttttttttttttttttttttttt

SEQ ID NO: 3965 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnctcatgacnntttttttttttttttttttttttttttttt

SEQ ID NO: 3966 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngtatccagnntttttttttttttttttttttttttttttt

SEQ ID NO: 3967 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnacgcctatnntttttttttttttttttttttttttttttt

SEQ ID NO: 3968 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnaacgacctnntttttttttttttttttttttttttttttt

SEQ ID NO: 3969 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnatcaggctnntttttttttttttttttttttttttttttt

SEQ ID NO: 3970 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncaagttcgnntttttttttttttttttttttttttttttt

SEQ ID NO: 3971 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntagccaganntttttttttttttttttttttttttttttt

SEQ ID NO: 3972 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncaatcacgnntttttttttttttttttttttttttttttt

SEQ ID NO: 3973 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnngcaacaagnntttttttttttttttttttttttttttttt

SEQ ID NO: 3974 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncacgacaanntttttttttttttttttttttttttttttt

SEQ ID NO: 3975 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntacggaganntttttttttttttttttttttttttttttt

SEQ ID NO: 3976 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncgacaaganntttttttttttttttttttttttttttttt

SEQ ID NO: 3977 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncgaagtganntttttttttttttttttttttttttttttt

SEQ ID NO: 3978 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnagctggtanntttttttttttttttttttttttttttttt

SEQ ID NO: 3979 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnaactaggcnntttttttttttttttttttttttttttttt

SEQ ID NO: 3980 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncagcaagtnntttttttttttttttttttttttttttttt

SEQ ID NO: 3981 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnacgaggtanntttttttttttttttttttttttttttttt

SEQ ID NO: 3982 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncatcttccnntttttttttttttttttttttttttttttt

SEQ ID NO: 3983 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncctgaatcnntttttttttttttttttttttttttttttt

SEQ ID NO: 3984 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnntgcagactnntttttttttttttttttttttttttttttt

SEQ ID NO: 3985 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnagatgtggnntttttttttttttttttttttttttttttt

SEQ ID NO: 3986 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnagttcgacnntttttttttttttttttttttttttttttt

SEQ ID NO: 3987 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnnacaacctcnntttttttttttttttttttttttttttttt

SEQ ID NO: 3988 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncatggtagnntttttttttttttttttttttttttttttt

SEQ ID NO: 3989 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncgtatctcnntttttttttttttttttttttttttttttt

SEQ ID NO: 3990 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncctagttcnntttttttttttttttttttttttttttttt

SEQ ID NO: 3991 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgacttgnncaagagtcnntttttttttttttttttttttttttttttt

SEQ ID NO: 3992 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannaatcggcanntttttttttttttttttttttttttttttt

SEQ ID NO: 3993 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntacggcatnntttttttttttttttttttttttttttttt

SEQ ID NO: 3994 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannttggatcgnntttttttttttttttttttttttttttttt

SEQ ID NO: 3995 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntggaacganntttttttttttttttttttttttttttttt

SEQ ID NO: 3996 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannggcaatcanntttttttttttttttttttttttttttttt

SEQ ID NO: 3997 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngaatccganntttttttttttttttttttttttttttttt

SEQ ID NO: 3998 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannttacggtgnntttttttttttttttttttttttttttttt

SEQ ID NO: 3999 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncatatcggnntttttttttttttttttttttttttttttt

SEQ ID NO: 4000 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncttcggtanntttttttttttttttttttttttttttttt

SEQ ID NO: 4001 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntcctaacgnntttttttttttttttttttttttttttttt

SEQ ID NO: 4002 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngtaagccanntttttttttttttttttttttttttttttt

SEQ ID NO: 4003 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntaaggtggnntttttttttttttttttttttttttttttt

SEQ ID NO: 4004 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannggtaagctnntttttttttttttttttttttttttttttt

SEQ ID NO: 4005 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntgtgtcganntttttttttttttttttttttttttttttt

SEQ ID NO: 4006 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngagcatganntttttttttttttttttttttttttttttt

SEQ ID NO: 4007 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntcgaagtcnntttttttttttttttttttttttttttttt

SEQ ID NO: 4008 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannggtgaacanntttttttttttttttttttttttttttttt

SEQ ID NO: 4009 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannacatgcacnntttttttttttttttttttttttttttttt

SEQ ID NO: 4010 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannccaacagtnntttttttttttttttttttttttttttttt

SEQ ID NO: 4011 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannagaacagcnntttttttttttttttttttttttttttttt

SEQ ID NO: 4012 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngaacacgtnntttttttttttttttttttttttttttttt

SEQ ID NO: 4013 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannggtcttcanntttttttttttttttttttttttttttttt

SEQ ID NO: 4014 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannaggttcagnntttttttttttttttttttttttttttttt

SEQ ID NO: 4015 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannctagagcanntttttttttttttttttttttttttttttt

SEQ ID NO: 4016 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncttctagcnntttttttttttttttttttttttttttttt

SEQ ID NO: 4017 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngagtaacgnntttttttttttttttttttttttttttttt

SEQ ID NO: 4018 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannctaagaggnntttttttttttttttttttttttttttttt

SEQ ID NO: 4019 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannacgtgtagnntttttttttttttttttttttttttttttt

SEQ ID NO: 4020 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannactacaggnntttttttttttttttttttttttttttttt

SEQ ID NO: 4021 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntacaggtcnntttttttttttttttttttttttttttttt

SEQ ID NO: 4022 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannctcacatgnntttttttttttttttttttttttttttttt

SEQ ID NO: 4023 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannactaggagnntttttttttttttttttttttttttttttt

SEQ ID NO: 4024 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannccatagganntttttttttttttttttttttttttttttt

SEQ ID NO: 4025 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannggagaatcnntttttttttttttttttttttttttttttt

SEQ ID NO: 4026 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngccaagaanntttttttttttttttttttttttttttttt

SEQ ID NO: 4027 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannaaggcaagnntttttttttttttttttttttttttttttt

SEQ ID NO: 4028 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannaatgtcgcnntttttttttttttttttttttttttttttt

SEQ ID NO: 4029 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannatggaaccnntttttttttttttttttttttttttttttt

SEQ ID NO: 4030 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannagaggcatnntttttttttttttttttttttttttttttt

SEQ ID NO: 4031 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntgcatagcnntttttttttttttttttttttttttttttt

SEQ ID NO: 4032 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannctaacgganntttttttttttttttttttttttttttttt

SEQ ID NO: 4033 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntatcgaggnntttttttttttttttttttttttttttttt

SEQ ID NO: 4034 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncatagcctnntttttttttttttttttttttttttttttt

SEQ ID NO: 4035 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannatcgagacnntttttttttttttttttttttttttttttt

SEQ ID NO: 4036 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannggaagagtnntttttttttttttttttttttttttttttt

SEQ ID NO: 4037 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannccaagtagnntttttttttttttttttttttttttttttt

SEQ ID NO: 4038 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannctgaacagnntttttttttttttttttttttttttttttt

SEQ ID NO: 4039 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngtaggttcnntttttttttttttttttttttttttttttt

SEQ ID NO: 4040 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngtatggacnntttttttttttttttttttttttttttttt

SEQ ID NO: 4041 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntcgcaacanntttttttttttttttttttttttttttttt

SEQ ID NO: 4042 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannccgctaatnntttttttttttttttttttttttttttttt

SEQ ID NO: 4043 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngattcgcanntttttttttttttttttttttttttttttt

SEQ ID NO: 4044 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncgatggaanntttttttttttttttttttttttttttttt

SEQ ID NO: 4045 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannagcaagganntttttttttttttttttttttttttttttt

SEQ ID NO: 4046 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncgtagcaanntttttttttttttttttttttttttttttt

SEQ ID NO: 4047 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntggcagtanntttttttttttttttttttttttttttttt

SEQ ID NO: 4048 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncggtagttnntttttttttttttttttttttttttttttt

SEQ ID NO: 4049 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntgacttcgnntttttttttttttttttttttttttttttt

SEQ ID NO: 4050 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngagtgcaanntttttttttttttttttttttttttttttt

SEQ ID NO: 4051 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannacggtaacnntttttttttttttttttttttttttttttt

SEQ ID NO: 4052 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannaagtggtgnntttttttttttttttttttttttttttttt

SEQ ID NO: 4053 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannggagacaanntttttttttttttttttttttttttttttt

SEQ ID NO: 4054 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntcaaggacnntttttttttttttttttttttttttttttt

SEQ ID NO: 4055 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannaagagagcnntttttttttttttttttttttttttttttt

SEQ ID NO: 4056 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncgagagatnntttttttttttttttttttttttttttttt

SEQ ID NO: 4057 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannacagatggnntttttttttttttttttttttttttttttt

SEQ ID NO: 4058 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannaggagtcanntttttttttttttttttttttttttttttt

SEQ ID NO: 4059 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncgtgttacnntttttttttttttttttttttttttttttt

SEQ ID NO: 4060 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntagtgtgcnntttttttttttttttttttttttttttttt

SEQ ID NO: 4061 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannctcatgacnntttttttttttttttttttttttttttttt

SEQ ID NO: 4062 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngtatccagnntttttttttttttttttttttttttttttt

SEQ ID NO: 4063 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannacgcctatnntttttttttttttttttttttttttttttt

SEQ ID NO: 4064 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannaacgacctnntttttttttttttttttttttttttttttt

SEQ ID NO: 4065 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannatcaggctnntttttttttttttttttttttttttttttt

SEQ ID NO: 4066 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncaagttcgnntttttttttttttttttttttttttttttt

SEQ ID NO: 4067 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntagccaganntttttttttttttttttttttttttttttt

SEQ ID NO: 4068 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncaatcacgnntttttttttttttttttttttttttttttt

SEQ ID NO: 4069 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganngcaacaagnntttttttttttttttttttttttttttttt

SEQ ID NO: 4070 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncacgacaanntttttttttttttttttttttttttttttt

SEQ ID NO: 4071 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntacggaganntttttttttttttttttttttttttttttt

SEQ ID NO: 4072 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncgacaaganntttttttttttttttttttttttttttttt

SEQ ID NO: 4073 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncgaagtganntttttttttttttttttttttttttttttt

SEQ ID NO: 4074 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannagctggtanntttttttttttttttttttttttttttttt

SEQ ID NO: 4075 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannaactaggcnntttttttttttttttttttttttttttttt

SEQ ID NO: 4076 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncagcaagtnntttttttttttttttttttttttttttttt

SEQ ID NO: 4077 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannacgaggtanntttttttttttttttttttttttttttttt

SEQ ID NO: 4078 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncatcttccnntttttttttttttttttttttttttttttt

SEQ ID NO: 4079 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncctgaatcnntttttttttttttttttttttttttttttt

SEQ ID NO: 4080 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganntgcagactnntttttttttttttttttttttttttttttt

SEQ ID NO: 4081 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannagatgtggnntttttttttttttttttttttttttttttt

SEQ ID NO: 4082 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannagttcgacnntttttttttttttttttttttttttttttt

SEQ ID NO: 4083 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgagannacaacctcnntttttttttttttttttttttttttttttt

SEQ ID NO: 4084 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncatggtagnntttttttttttttttttttttttttttttt

SEQ ID NO: 4085 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncgtatctcnntttttttttttttttttttttttttttttt

SEQ ID NO: 4086 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncctagttcnntttttttttttttttttttttttttttttt

SEQ ID NO: 4087 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttcgaganncaagagtcnntttttttttttttttttttttttttttttt

SEQ ID NO: 4088 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnaatcggcanntttttttttttttttttttttttttttttt

SEQ ID NO: 4089 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntacggcatnntttttttttttttttttttttttttttttt

SEQ ID NO: 4090 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnttggatcgnntttttttttttttttttttttttttttttt

SEQ ID NO: 4091 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntggaacganntttttttttttttttttttttttttttttt

SEQ ID NO: 4092 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnggcaatcanntttttttttttttttttttttttttttttt

SEQ ID NO: 4093 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngaatccganntttttttttttttttttttttttttttttt

SEQ ID NO: 4094 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnttacggtgnntttttttttttttttttttttttttttttt

SEQ ID NO: 4095 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncatatcggnntttttttttttttttttttttttttttttt

SEQ ID NO: 4096 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncttcggtanntttttttttttttttttttttttttttttt

SEQ ID NO: 4097 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntcctaacgnntttttttttttttttttttttttttttttt

SEQ ID NO: 4098 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngtaagccanntttttttttttttttttttttttttttttt

SEQ ID NO: 4099 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntaaggtggnntttttttttttttttttttttttttttttt

SEQ ID NO: 4100 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnggtaagctnntttttttttttttttttttttttttttttt

SEQ ID NO: 4101 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntgtgtcganntttttttttttttttttttttttttttttt

SEQ ID NO: 4102 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngagcatganntttttttttttttttttttttttttttttt

SEQ ID NO: 4103 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntcgaagtcnntttttttttttttttttttttttttttttt

SEQ ID NO: 4104 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnggtgaacanntttttttttttttttttttttttttttttt

SEQ ID NO: 4105 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnacatgcacnntttttttttttttttttttttttttttttt

SEQ ID NO: 4106 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnccaacagtnntttttttttttttttttttttttttttttt

SEQ ID NO: 4107 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnagaacagcnntttttttttttttttttttttttttttttt

SEQ ID NO: 4108 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngaacacgtnntttttttttttttttttttttttttttttt

SEQ ID NO: 4109 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnggtcttcanntttttttttttttttttttttttttttttt

SEQ ID NO: 4110 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnaggttcagnntttttttttttttttttttttttttttttt

SEQ ID NO: 4111 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnctagagcanntttttttttttttttttttttttttttttt

SEQ ID NO: 4112 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncttctagcnntttttttttttttttttttttttttttttt

SEQ ID NO: 4113 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngagtaacgnntttttttttttttttttttttttttttttt

SEQ ID NO: 4114 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnctaagaggnntttttttttttttttttttttttttttttt

SEQ ID NO: 4115 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnacgtgtagnntttttttttttttttttttttttttttttt

SEQ ID NO: 4116 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnactacaggnntttttttttttttttttttttttttttttt

SEQ ID NO: 4117 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntacaggtcnntttttttttttttttttttttttttttttt

SEQ ID NO: 4118 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnctcacatgnntttttttttttttttttttttttttttttt

SEQ ID NO: 4119 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnactaggagnntttttttttttttttttttttttttttttt

SEQ ID NO: 4120 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnccatagganntttttttttttttttttttttttttttttt

SEQ ID NO: 4121 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnggagaatcnntttttttttttttttttttttttttttttt

SEQ ID NO: 4122 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngccaagaanntttttttttttttttttttttttttttttt

SEQ ID NO: 4123 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnaaggcaagnntttttttttttttttttttttttttttttt

SEQ ID NO: 4124 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnaatgtcgcnntttttttttttttttttttttttttttttt

SEQ ID NO: 4125 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnatggaaccnntttttttttttttttttttttttttttttt

SEQ ID NO: 4126 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnagaggcatnntttttttttttttttttttttttttttttt

SEQ ID NO: 4127 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntgcatagcnntttttttttttttttttttttttttttttt

SEQ ID NO: 4128 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnctaacgganntttttttttttttttttttttttttttttt

SEQ ID NO: 4129 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntatcgaggnntttttttttttttttttttttttttttttt

SEQ ID NO: 4130 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncatagcctnntttttttttttttttttttttttttttttt

SEQ ID NO: 4131 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnatcgagacnntttttttttttttttttttttttttttttt

SEQ ID NO: 4132 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnggaagagtnntttttttttttttttttttttttttttttt

SEQ ID NO: 4133 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnccaagtagnntttttttttttttttttttttttttttttt

SEQ ID NO: 4134 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnctgaacagnntttttttttttttttttttttttttttttt

SEQ ID NO: 4135 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngtaggttcnntttttttttttttttttttttttttttttt

SEQ ID NO: 4136 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngtatggacnntttttttttttttttttttttttttttttt

SEQ ID NO: 4137 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntcgcaacanntttttttttttttttttttttttttttttt

SEQ ID NO: 4138 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnccgctaatnntttttttttttttttttttttttttttttt

SEQ ID NO: 4139 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngattcgcanntttttttttttttttttttttttttttttt

SEQ ID NO: 4140 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncgatggaanntttttttttttttttttttttttttttttt

SEQ ID NO: 4141 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnagcaagganntttttttttttttttttttttttttttttt

SEQ ID NO: 4142 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncgtagcaanntttttttttttttttttttttttttttttt

SEQ ID NO: 4143 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntggcagtanntttttttttttttttttttttttttttttt

SEQ ID NO: 4144 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncggtagttnntttttttttttttttttttttttttttttt

SEQ ID NO: 4145 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntgacttcgnntttttttttttttttttttttttttttttt

SEQ ID NO: 4146 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngagtgcaanntttttttttttttttttttttttttttttt

SEQ ID NO: 4147 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnacggtaacnntttttttttttttttttttttttttttttt

SEQ ID NO: 4148 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnaagtggtgnntttttttttttttttttttttttttttttt

SEQ ID NO: 4149 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnggagacaanntttttttttttttttttttttttttttttt

SEQ ID NO: 4150 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntcaaggacnntttttttttttttttttttttttttttttt

SEQ ID NO: 4151 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnaagagagcnntttttttttttttttttttttttttttttt

SEQ ID NO: 4152 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncgagagatnntttttttttttttttttttttttttttttt

SEQ ID NO: 4153 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnacagatggnntttttttttttttttttttttttttttttt

SEQ ID NO: 4154 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnaggagtcanntttttttttttttttttttttttttttttt

SEQ ID NO: 4155 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncgtgttacnntttttttttttttttttttttttttttttt

SEQ ID NO: 4156 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntagtgtgcnntttttttttttttttttttttttttttttt

SEQ ID NO: 4157 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnctcatgacnntttttttttttttttttttttttttttttt

SEQ ID NO: 4158 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngtatccagnntttttttttttttttttttttttttttttt

SEQ ID NO: 4159 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnacgcctatnntttttttttttttttttttttttttttttt

SEQ ID NO: 4160 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnaacgacctnntttttttttttttttttttttttttttttt

SEQ ID NO: 4161 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnatcaggctnntttttttttttttttttttttttttttttt

SEQ ID NO: 4162 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncaagttcgnntttttttttttttttttttttttttttttt

SEQ ID NO: 4163 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntagccaganntttttttttttttttttttttttttttttt

SEQ ID NO: 4164 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncaatcacgnntttttttttttttttttttttttttttttt

SEQ ID NO: 4165 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnngcaacaagnntttttttttttttttttttttttttttttt

SEQ ID NO: 4166 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncacgacaanntttttttttttttttttttttttttttttt

SEQ ID NO: 4167 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntacggaganntttttttttttttttttttttttttttttt

SEQ ID NO: 4168 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncgacaaganntttttttttttttttttttttttttttttt

SEQ ID NO: 4169 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncgaagtganntttttttttttttttttttttttttttttt

SEQ ID NO: 4170 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnagctggtanntttttttttttttttttttttttttttttt

SEQ ID NO: 4171 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnaactaggcnntttttttttttttttttttttttttttttt

SEQ ID NO: 4172 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncagcaagtnntttttttttttttttttttttttttttttt

SEQ ID NO: 4173 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnacgaggtanntttttttttttttttttttttttttttttt

SEQ ID NO: 4174 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncatcttccnntttttttttttttttttttttttttttttt

SEQ ID NO: 4175 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncctgaatcnntttttttttttttttttttttttttttttt

SEQ ID NO: 4176 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnntgcagactnntttttttttttttttttttttttttttttt

SEQ ID NO: 4177 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnagatgtggnntttttttttttttttttttttttttttttt

SEQ ID NO: 4178 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnagttcgacnntttttttttttttttttttttttttttttt

SEQ ID NO: 4179 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnnacaacctcnntttttttttttttttttttttttttttttt

SEQ ID NO: 4180 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncatggtagnntttttttttttttttttttttttttttttt

SEQ ID NO: 4181 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncgtatctcnntttttttttttttttttttttttttttttt

SEQ ID NO: 4182 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncctagttcnntttttttttttttttttttttttttttttt

SEQ ID NO: 4183 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcctaggtnncaagagtcnntttttttttttttttttttttttttttttt

SEQ ID NO: 4184 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannaatcggcanntttttttttttttttttttttttttttttt

SEQ ID NO: 4185 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntacggcatnntttttttttttttttttttttttttttttt

SEQ ID NO: 4186 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannttggatcgnntttttttttttttttttttttttttttttt

SEQ ID NO: 4187 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntggaacganntttttttttttttttttttttttttttttt

SEQ ID NO: 4188 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannggcaatcanntttttttttttttttttttttttttttttt

SEQ ID NO: 4189 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngaatccganntttttttttttttttttttttttttttttt

SEQ ID NO: 4190 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannttacggtgnntttttttttttttttttttttttttttttt

SEQ ID NO: 4191 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncatatcggnntttttttttttttttttttttttttttttt

SEQ ID NO: 4192 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncttcggtanntttttttttttttttttttttttttttttt

SEQ ID NO: 4193 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntcctaacgnntttttttttttttttttttttttttttttt

SEQ ID NO: 4194 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngtaagccanntttttttttttttttttttttttttttttt

SEQ ID NO: 4195 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntaaggtggnntttttttttttttttttttttttttttttt

SEQ ID NO: 4196 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannggtaagctnntttttttttttttttttttttttttttttt

SEQ ID NO: 4197 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntgtgtcganntttttttttttttttttttttttttttttt

SEQ ID NO: 4198 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngagcatganntttttttttttttttttttttttttttttt

SEQ ID NO: 4199 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntcgaagtcnntttttttttttttttttttttttttttttt

SEQ ID NO: 4200 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannggtgaacanntttttttttttttttttttttttttttttt

SEQ ID NO: 4201 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannacatgcacnntttttttttttttttttttttttttttttt

SEQ ID NO: 4202 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannccaacagtnntttttttttttttttttttttttttttttt

SEQ ID NO: 4203 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannagaacagcnntttttttttttttttttttttttttttttt

SEQ ID NO: 4204 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngaacacgtnntttttttttttttttttttttttttttttt

SEQ ID NO: 4205 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannggtcttcanntttttttttttttttttttttttttttttt

SEQ ID NO: 4206 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannaggttcagnntttttttttttttttttttttttttttttt

SEQ ID NO: 4207 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannctagagcanntttttttttttttttttttttttttttttt

SEQ ID NO: 4208 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncttctagcnntttttttttttttttttttttttttttttt

SEQ ID NO: 4209 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngagtaacgnntttttttttttttttttttttttttttttt

SEQ ID NO: 4210 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannctaagaggnntttttttttttttttttttttttttttttt

SEQ ID NO: 4211 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannacgtgtagnntttttttttttttttttttttttttttttt

SEQ ID NO: 4212 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannactacaggnntttttttttttttttttttttttttttttt

SEQ ID NO: 4213 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntacaggtcnntttttttttttttttttttttttttttttt

SEQ ID NO: 4214 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannctcacatgnntttttttttttttttttttttttttttttt

SEQ ID NO: 4215 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannactaggagnntttttttttttttttttttttttttttttt

SEQ ID NO: 4216 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannccatagganntttttttttttttttttttttttttttttt

SEQ ID NO: 4217 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannggagaatcnntttttttttttttttttttttttttttttt

SEQ ID NO: 4218 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngccaagaanntttttttttttttttttttttttttttttt

SEQ ID NO: 4219 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannaaggcaagnntttttttttttttttttttttttttttttt

SEQ ID NO: 4220 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannaatgtcgcnntttttttttttttttttttttttttttttt

SEQ ID NO: 4221 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannatggaaccnntttttttttttttttttttttttttttttt

SEQ ID NO: 4222 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannagaggcatnntttttttttttttttttttttttttttttt

SEQ ID NO: 4223 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntgcatagcnntttttttttttttttttttttttttttttt

SEQ ID NO: 4224 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannctaacgganntttttttttttttttttttttttttttttt

SEQ ID NO: 4225 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntatcgaggnntttttttttttttttttttttttttttttt

SEQ ID NO: 4226 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncatagcctnntttttttttttttttttttttttttttttt

SEQ ID NO: 4227 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannatcgagacnntttttttttttttttttttttttttttttt

SEQ ID NO: 4228 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannggaagagtnntttttttttttttttttttttttttttttt

SEQ ID NO: 4229 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannccaagtagnntttttttttttttttttttttttttttttt

SEQ ID NO: 4230 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannctgaacagnntttttttttttttttttttttttttttttt

SEQ ID NO: 4231 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngtaggttcnntttttttttttttttttttttttttttttt

SEQ ID NO: 4232 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngtatggacnntttttttttttttttttttttttttttttt

SEQ ID NO: 4233 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntcgcaacanntttttttttttttttttttttttttttttt

SEQ ID NO: 4234 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannccgctaatnntttttttttttttttttttttttttttttt

SEQ ID NO: 4235 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngattcgcanntttttttttttttttttttttttttttttt

SEQ ID NO: 4236 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncgatggaanntttttttttttttttttttttttttttttt

SEQ ID NO: 4237 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannagcaagganntttttttttttttttttttttttttttttt

SEQ ID NO: 4238 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncgtagcaanntttttttttttttttttttttttttttttt

SEQ ID NO: 4239 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntggcagtanntttttttttttttttttttttttttttttt

SEQ ID NO: 4240 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncggtagttnntttttttttttttttttttttttttttttt

SEQ ID NO: 4241 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntgacttcgnntttttttttttttttttttttttttttttt

SEQ ID NO: 4242 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngagtgcaanntttttttttttttttttttttttttttttt

SEQ ID NO: 4243 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannacggtaacnntttttttttttttttttttttttttttttt

SEQ ID NO: 4244 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannaagtggtgnntttttttttttttttttttttttttttttt

SEQ ID NO: 4245 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannggagacaanntttttttttttttttttttttttttttttt

SEQ ID NO: 4246 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntcaaggacnntttttttttttttttttttttttttttttt

SEQ ID NO: 4247 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannaagagagcnntttttttttttttttttttttttttttttt

SEQ ID NO: 4248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncgagagatnntttttttttttttttttttttttttttttt

SEQ ID NO: 4249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannacagatggnntttttttttttttttttttttttttttttt

SEQ ID NO: 4250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannaggagtcanntttttttttttttttttttttttttttttt

SEQ ID NO: 4251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncgtgttacnntttttttttttttttttttttttttttttt

SEQ ID NO: 4252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntagtgtgcnntttttttttttttttttttttttttttttt

SEQ ID NO: 4253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannctcatgacnntttttttttttttttttttttttttttttt

SEQ ID NO: 4254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngtatccagnntttttttttttttttttttttttttttttt

SEQ ID NO: 4255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannacgcctatnntttttttttttttttttttttttttttttt

SEQ ID NO: 4256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannaacgacctnntttttttttttttttttttttttttttttt

SEQ ID NO: 4257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannatcaggctnntttttttttttttttttttttttttttttt

SEQ ID NO: 4258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncaagttcgnntttttttttttttttttttttttttttttt

SEQ ID NO: 4259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntagccaganntttttttttttttttttttttttttttttt

SEQ ID NO: 4260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncaatcacgnntttttttttttttttttttttttttttttt

SEQ ID NO: 4261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganngcaacaagnntttttttttttttttttttttttttttttt

SEQ ID NO: 4262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncacgacaanntttttttttttttttttttttttttttttt

SEQ ID NO: 4263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntacggaganntttttttttttttttttttttttttttttt

SEQ ID NO: 4264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncgacaaganntttttttttttttttttttttttttttttt

SEQ ID NO: 4265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncgaagtganntttttttttttttttttttttttttttttt

SEQ ID NO: 4266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannagctggtanntttttttttttttttttttttttttttttt

SEQ ID NO: 4267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannaactaggcnntttttttttttttttttttttttttttttt

SEQ ID NO: 4268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncagcaagtnntttttttttttttttttttttttttttttt

SEQ ID NO: 4269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannacgaggtanntttttttttttttttttttttttttttttt

SEQ ID NO: 4270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncatcttccnntttttttttttttttttttttttttttttt

SEQ ID NO: 4271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncctgaatcnntttttttttttttttttttttttttttttt

SEQ ID NO: 4272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganntgcagactnntttttttttttttttttttttttttttttt

SEQ ID NO: 4273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannagatgtggnntttttttttttttttttttttttttttttt

SEQ ID NO: 4274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannagttcgacnntttttttttttttttttttttttttttttt

SEQ ID NO: 4275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacgannacaacctcnntttttttttttttttttttttttttttttt

SEQ ID NO: 4276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncatggtagnntttttttttttttttttttttttttttttt

SEQ ID NO: 4277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncgtatctcnntttttttttttttttttttttttttttttt

SEQ ID NO: 4278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncctagttcnntttttttttttttttttttttttttttttt

SEQ ID NO: 4279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatgacganncaagagtcnntttttttttttttttttttttttttttttt

SEQ ID NO: 4280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnaatcggcanntttttttttttttttttttttttttttttt

SEQ ID NO: 4281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntacggcatnntttttttttttttttttttttttttttttt

SEQ ID NO: 4282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnttggatcgnntttttttttttttttttttttttttttttt

SEQ ID NO: 4283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntggaacganntttttttttttttttttttttttttttttt

SEQ ID NO: 4284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnggcaatcanntttttttttttttttttttttttttttttt

SEQ ID NO: 4285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngaatccganntttttttttttttttttttttttttttttt

SEQ ID NO: 4286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnttacggtgnntttttttttttttttttttttttttttttt

SEQ ID NO: 4287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncatatcggnntttttttttttttttttttttttttttttt

SEQ ID NO: 4288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncttcggtanntttttttttttttttttttttttttttttt

SEQ ID NO: 4289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntcctaacgnntttttttttttttttttttttttttttttt

SEQ ID NO: 4290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngtaagccanntttttttttttttttttttttttttttttt

SEQ ID NO: 4291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntaaggtggnntttttttttttttttttttttttttttttt

SEQ ID NO: 4292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnggtaagctnntttttttttttttttttttttttttttttt

SEQ ID NO: 4293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntgtgtcganntttttttttttttttttttttttttttttt

SEQ ID NO: 4294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngagcatganntttttttttttttttttttttttttttttt

SEQ ID NO: 4295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntcgaagtcnntttttttttttttttttttttttttttttt

SEQ ID NO: 4296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnggtgaacanntttttttttttttttttttttttttttttt

SEQ ID NO: 4297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnacatgcacnntttttttttttttttttttttttttttttt

SEQ ID NO: 4298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnccaacagtnntttttttttttttttttttttttttttttt

SEQ ID NO: 4299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnagaacagcnntttttttttttttttttttttttttttttt

SEQ ID NO: 4300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngaacacgtnntttttttttttttttttttttttttttttt

SEQ ID NO: 4301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnggtcttcanntttttttttttttttttttttttttttttt

SEQ ID NO: 4302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnaggttcagnntttttttttttttttttttttttttttttt

SEQ ID NO: 4303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnctagagcanntttttttttttttttttttttttttttttt

SEQ ID NO: 4304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncttctagcnntttttttttttttttttttttttttttttt

SEQ ID NO: 4305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngagtaacgnntttttttttttttttttttttttttttttt

SEQ ID NO: 4306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnctaagaggnntttttttttttttttttttttttttttttt

SEQ ID NO: 4307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnacgtgtagnntttttttttttttttttttttttttttttt

SEQ ID NO: 4308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnactacaggnntttttttttttttttttttttttttttttt

SEQ ID NO: 4309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntacaggtcnntttttttttttttttttttttttttttttt

SEQ ID NO: 4310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnctcacatgnntttttttttttttttttttttttttttttt

SEQ ID NO: 4311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnactaggagnntttttttttttttttttttttttttttttt

SEQ ID NO: 4312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnccatagganntttttttttttttttttttttttttttttt

SEQ ID NO: 4313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnggagaatcnntttttttttttttttttttttttttttttt

SEQ ID NO: 4314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngccaagaanntttttttttttttttttttttttttttttt

SEQ ID NO: 4315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnaaggcaagnntttttttttttttttttttttttttttttt

SEQ ID NO: 4316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnaatgtcgcnntttttttttttttttttttttttttttttt

SEQ ID NO: 4317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnatggaaccnntttttttttttttttttttttttttttttt

SEQ ID NO: 4318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnagaggcatnntttttttttttttttttttttttttttttt

SEQ ID NO: 4319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntgcatagcnntttttttttttttttttttttttttttttt

SEQ ID NO: 4320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnctaacgganntttttttttttttttttttttttttttttt

SEQ ID NO: 4321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntatcgaggnntttttttttttttttttttttttttttttt

SEQ ID NO: 4322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncatagcctnntttttttttttttttttttttttttttttt

SEQ ID NO: 4323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnatcgagacnntttttttttttttttttttttttttttttt

SEQ ID NO: 4324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnggaagagtnntttttttttttttttttttttttttttttt

SEQ ID NO: 4325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnccaagtagnntttttttttttttttttttttttttttttt

SEQ ID NO: 4326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnctgaacagnntttttttttttttttttttttttttttttt

SEQ ID NO: 4327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngtaggttcnntttttttttttttttttttttttttttttt

SEQ ID NO: 4328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngtatggacnntttttttttttttttttttttttttttttt

SEQ ID NO: 4329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntcgcaacanntttttttttttttttttttttttttttttt

SEQ ID NO: 4330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnccgctaatnntttttttttttttttttttttttttttttt

SEQ ID NO: 4331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngattcgcanntttttttttttttttttttttttttttttt

SEQ ID NO: 4332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncgatggaanntttttttttttttttttttttttttttttt

SEQ ID NO: 4333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnagcaagganntttttttttttttttttttttttttttttt

SEQ ID NO: 4334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncgtagcaanntttttttttttttttttttttttttttttt

SEQ ID NO: 4335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntggcagtanntttttttttttttttttttttttttttttt

SEQ ID NO: 4336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncggtagttnntttttttttttttttttttttttttttttt

SEQ ID NO: 4337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntgacttcgnntttttttttttttttttttttttttttttt

SEQ ID NO: 4338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngagtgcaanntttttttttttttttttttttttttttttt

SEQ ID NO: 4339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnacggtaacnntttttttttttttttttttttttttttttt

SEQ ID NO: 4340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnaagtggtgnntttttttttttttttttttttttttttttt

SEQ ID NO: 4341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnggagacaanntttttttttttttttttttttttttttttt

SEQ ID NO: 4342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntcaaggacnntttttttttttttttttttttttttttttt

SEQ ID NO: 4343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnaagagagcnntttttttttttttttttttttttttttttt

SEQ ID NO: 4344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncgagagatnntttttttttttttttttttttttttttttt

SEQ ID NO: 4345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnacagatggnntttttttttttttttttttttttttttttt

SEQ ID NO: 4346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnaggagtcanntttttttttttttttttttttttttttttt

SEQ ID NO: 4347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncgtgttacnntttttttttttttttttttttttttttttt

SEQ ID NO: 4348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntagtgtgcnntttttttttttttttttttttttttttttt

SEQ ID NO: 4349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnctcatgacnntttttttttttttttttttttttttttttt

SEQ ID NO: 4350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngtatccagnntttttttttttttttttttttttttttttt

SEQ ID NO: 4351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnacgcctatnntttttttttttttttttttttttttttttt

SEQ ID NO: 4352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnaacgacctnntttttttttttttttttttttttttttttt

SEQ ID NO: 4353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnatcaggctnntttttttttttttttttttttttttttttt

SEQ ID NO: 4354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncaagttcgnntttttttttttttttttttttttttttttt

SEQ ID NO: 4355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntagccaganntttttttttttttttttttttttttttttt

SEQ ID NO: 4356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncaatcacgnntttttttttttttttttttttttttttttt

SEQ ID NO: 4357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnngcaacaagnntttttttttttttttttttttttttttttt

SEQ ID NO: 4358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncacgacaanntttttttttttttttttttttttttttttt

SEQ ID NO: 4359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntacggaganntttttttttttttttttttttttttttttt

SEQ ID NO: 4360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncgacaaganntttttttttttttttttttttttttttttt

SEQ ID NO: 4361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncgaagtganntttttttttttttttttttttttttttttt

SEQ ID NO: 4362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnagctggtanntttttttttttttttttttttttttttttt

SEQ ID NO: 4363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnaactaggcnntttttttttttttttttttttttttttttt

SEQ ID NO: 4364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncagcaagtnntttttttttttttttttttttttttttttt

SEQ ID NO: 4365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnacgaggtanntttttttttttttttttttttttttttttt

SEQ ID NO: 4366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncatcttccnntttttttttttttttttttttttttttttt

SEQ ID NO: 4367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncctgaatcnntttttttttttttttttttttttttttttt

SEQ ID NO: 4368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnntgcagactnntttttttttttttttttttttttttttttt

SEQ ID NO: 4369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnagatgtggnntttttttttttttttttttttttttttttt

SEQ ID NO: 4370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnagttcgacnntttttttttttttttttttttttttttttt

SEQ ID NO: 4371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnnacaacctcnntttttttttttttttttttttttttttttt

SEQ ID NO: 4372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncatggtagnntttttttttttttttttttttttttttttt

SEQ ID NO: 4373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncgtatctcnntttttttttttttttttttttttttttttt

SEQ ID NO: 4374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncctagttcnntttttttttttttttttttttttttttttt

SEQ ID NO: 4375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatgtcgagnncaagagtcnntttttttttttttttttttttttttttttt

SEQ ID NO: 4376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnaatcggcanntttttttttttttttttttttttttttttt

SEQ ID NO: 4377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntacggcatnntttttttttttttttttttttttttttttt

SEQ ID NO: 4378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnttggatcgnntttttttttttttttttttttttttttttt

SEQ ID NO: 4379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntggaacganntttttttttttttttttttttttttttttt

SEQ ID NO: 4380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnggcaatcanntttttttttttttttttttttttttttttt

SEQ ID NO: 4381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngaatccganntttttttttttttttttttttttttttttt

SEQ ID NO: 4382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnttacggtgnntttttttttttttttttttttttttttttt

SEQ ID NO: 4383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncatatcggnntttttttttttttttttttttttttttttt

SEQ ID NO: 4384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncttcggtanntttttttttttttttttttttttttttttt

SEQ ID NO: 4385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntcctaacgnntttttttttttttttttttttttttttttt

SEQ ID NO: 4386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngtaagccanntttttttttttttttttttttttttttttt

SEQ ID NO: 4387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntaaggtggnntttttttttttttttttttttttttttttt

SEQ ID NO: 4388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnggtaagctnntttttttttttttttttttttttttttttt

SEQ ID NO: 4389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntgtgtcganntttttttttttttttttttttttttttttt

SEQ ID NO: 4390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngagcatganntttttttttttttttttttttttttttttt

SEQ ID NO: 4391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntcgaagtcnntttttttttttttttttttttttttttttt

SEQ ID NO: 4392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnggtgaacanntttttttttttttttttttttttttttttt

SEQ ID NO: 4393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnacatgcacnntttttttttttttttttttttttttttttt

SEQ ID NO: 4394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnccaacagtnntttttttttttttttttttttttttttttt

SEQ ID NO: 4395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnagaacagcnntttttttttttttttttttttttttttttt

SEQ ID NO: 4396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngaacacgtnntttttttttttttttttttttttttttttt

SEQ ID NO: 4397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnggtcttcanntttttttttttttttttttttttttttttt

SEQ ID NO: 4398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnaggttcagnntttttttttttttttttttttttttttttt

SEQ ID NO: 4399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnctagagcanntttttttttttttttttttttttttttttt

SEQ ID NO: 4400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncttctagcnntttttttttttttttttttttttttttttt

SEQ ID NO: 4401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngagtaacgnntttttttttttttttttttttttttttttt

SEQ ID NO: 4402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnctaagaggnntttttttttttttttttttttttttttttt

SEQ ID NO: 4403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnacgtgtagnntttttttttttttttttttttttttttttt

SEQ ID NO: 4404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnactacaggnntttttttttttttttttttttttttttttt

SEQ ID NO: 4405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntacaggtcnntttttttttttttttttttttttttttttt

SEQ ID NO: 4406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnctcacatgnntttttttttttttttttttttttttttttt

SEQ ID NO: 4407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnactaggagnntttttttttttttttttttttttttttttt

SEQ ID NO: 4408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnccatagganntttttttttttttttttttttttttttttt

SEQ ID NO: 4409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnggagaatcnntttttttttttttttttttttttttttttt

SEQ ID NO: 4410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngccaagaanntttttttttttttttttttttttttttttt

SEQ ID NO: 4411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnaaggcaagnntttttttttttttttttttttttttttttt

SEQ ID NO: 4412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnaatgtcgcnntttttttttttttttttttttttttttttt

SEQ ID NO: 4413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnatggaaccnntttttttttttttttttttttttttttttt

SEQ ID NO: 4414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnagaggcatnntttttttttttttttttttttttttttttt

SEQ ID NO: 4415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntgcatagcnntttttttttttttttttttttttttttttt

SEQ ID NO: 4416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnctaacgganntttttttttttttttttttttttttttttt

SEQ ID NO: 4417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntatcgaggnntttttttttttttttttttttttttttttt

SEQ ID NO: 4418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncatagcctnntttttttttttttttttttttttttttttt

SEQ ID NO: 4419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnatcgagacnntttttttttttttttttttttttttttttt

SEQ ID NO: 4420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnggaagagtnntttttttttttttttttttttttttttttt

SEQ ID NO: 4421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnccaagtagnntttttttttttttttttttttttttttttt

SEQ ID NO: 4422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnctgaacagnntttttttttttttttttttttttttttttt

SEQ ID NO: 4423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngtaggttcnntttttttttttttttttttttttttttttt

SEQ ID NO: 4424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngtatggacnntttttttttttttttttttttttttttttt

SEQ ID NO: 4425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntcgcaacanntttttttttttttttttttttttttttttt

SEQ ID NO: 4426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnccgctaatnntttttttttttttttttttttttttttttt

SEQ ID NO: 4427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngattcgcanntttttttttttttttttttttttttttttt

SEQ ID NO: 4428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncgatggaanntttttttttttttttttttttttttttttt

SEQ ID NO: 4429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnagcaagganntttttttttttttttttttttttttttttt

SEQ ID NO: 4430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncgtagcaanntttttttttttttttttttttttttttttt

SEQ ID NO: 4431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntggcagtanntttttttttttttttttttttttttttttt

SEQ ID NO: 4432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncggtagttnntttttttttttttttttttttttttttttt

SEQ ID NO: 4433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntgacttcgnntttttttttttttttttttttttttttttt

SEQ ID NO: 4434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngagtgcaanntttttttttttttttttttttttttttttt

SEQ ID NO: 4435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnacggtaacnntttttttttttttttttttttttttttttt

SEQ ID NO: 4436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnaagtggtgnntttttttttttttttttttttttttttttt

SEQ ID NO: 4437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnggagacaanntttttttttttttttttttttttttttttt

SEQ ID NO: 4438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntcaaggacnntttttttttttttttttttttttttttttt

SEQ ID NO: 4439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnaagagagcnntttttttttttttttttttttttttttttt

SEQ ID NO: 4440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncgagagatnntttttttttttttttttttttttttttttt

SEQ ID NO: 4441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnacagatggnntttttttttttttttttttttttttttttt

SEQ ID NO: 4442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnaggagtcanntttttttttttttttttttttttttttttt

SEQ ID NO: 4443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncgtgttacnntttttttttttttttttttttttttttttt

SEQ ID NO: 4444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntagtgtgcnntttttttttttttttttttttttttttttt

SEQ ID NO: 4445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnctcatgacnntttttttttttttttttttttttttttttt

SEQ ID NO: 4446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngtatccagnntttttttttttttttttttttttttttttt

SEQ ID NO: 4447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnacgcctatnntttttttttttttttttttttttttttttt

SEQ ID NO: 4448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnaacgacctnntttttttttttttttttttttttttttttt

SEQ ID NO: 4449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnatcaggctnntttttttttttttttttttttttttttttt

SEQ ID NO: 4450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncaagttcgnntttttttttttttttttttttttttttttt

SEQ ID NO: 4451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntagccaganntttttttttttttttttttttttttttttt

SEQ ID NO: 4452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncaatcacgnntttttttttttttttttttttttttttttt

SEQ ID NO: 4453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnngcaacaagnntttttttttttttttttttttttttttttt

SEQ ID NO: 4454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncacgacaanntttttttttttttttttttttttttttttt

SEQ ID NO: 4455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntacggaganntttttttttttttttttttttttttttttt

SEQ ID NO: 4456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncgacaaganntttttttttttttttttttttttttttttt

SEQ ID NO: 4457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncgaagtganntttttttttttttttttttttttttttttt

SEQ ID NO: 4458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnagctggtanntttttttttttttttttttttttttttttt

SEQ ID NO: 4459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnaactaggcnntttttttttttttttttttttttttttttt

SEQ ID NO: 4460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncagcaagtnntttttttttttttttttttttttttttttt

SEQ ID NO: 4461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnacgaggtanntttttttttttttttttttttttttttttt

SEQ ID NO: 4462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncatcttccnntttttttttttttttttttttttttttttt

SEQ ID NO: 4463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncctgaatcnntttttttttttttttttttttttttttttt

SEQ ID NO: 4464 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnntgcagactnntttttttttttttttttttttttttttttt

SEQ ID NO: 4465 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnagatgtggnntttttttttttttttttttttttttttttt

SEQ ID NO: 4466 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnagttcgacnntttttttttttttttttttttttttttttt

SEQ ID NO: 4467 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnnacaacctcnntttttttttttttttttttttttttttttt

SEQ ID NO: 4468 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncatggtagnntttttttttttttttttttttttttttttt

SEQ ID NO: 4469 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncgtatctcnntttttttttttttttttttttttttttttt

SEQ ID NO: 4470 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncctagttcnntttttttttttttttttttttttttttttt

SEQ ID NO: 4471 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaacgtgtcnncaagagtcnntttttttttttttttttttttttttttttt

SEQ ID NO: 4472 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannaatcggcanntttttttttttttttttttttttttttttt

SEQ ID NO: 4473 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntacggcatnntttttttttttttttttttttttttttttt

SEQ ID NO: 4474 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannttggatcgnntttttttttttttttttttttttttttttt

SEQ ID NO: 4475 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntggaacganntttttttttttttttttttttttttttttt

SEQ ID NO: 4476 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannggcaatcanntttttttttttttttttttttttttttttt

SEQ ID NO: 4477 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngaatccganntttttttttttttttttttttttttttttt

SEQ ID NO: 4478 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannttacggtgnntttttttttttttttttttttttttttttt

SEQ ID NO: 4479 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncatatcggnntttttttttttttttttttttttttttttt

SEQ ID NO: 4480 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncttcggtanntttttttttttttttttttttttttttttt

SEQ ID NO: 4481 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntcctaacgnntttttttttttttttttttttttttttttt

SEQ ID NO: 4482 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngtaagccanntttttttttttttttttttttttttttttt

SEQ ID NO: 4483 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntaaggtggnntttttttttttttttttttttttttttttt

SEQ ID NO: 4484 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannggtaagctnntttttttttttttttttttttttttttttt

SEQ ID NO: 4485 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntgtgtcganntttttttttttttttttttttttttttttt

SEQ ID NO: 4486 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngagcatganntttttttttttttttttttttttttttttt

SEQ ID NO: 4487 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntcgaagtcnntttttttttttttttttttttttttttttt

SEQ ID NO: 4488 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannggtgaacanntttttttttttttttttttttttttttttt

SEQ ID NO: 4489 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannacatgcacnntttttttttttttttttttttttttttttt

SEQ ID NO: 4490 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannccaacagtnntttttttttttttttttttttttttttttt

SEQ ID NO: 4491 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannagaacagcnntttttttttttttttttttttttttttttt

SEQ ID NO: 4492 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngaacacgtnntttttttttttttttttttttttttttttt

SEQ ID NO: 4493 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannggtcttcanntttttttttttttttttttttttttttttt

SEQ ID NO: 4494 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannaggttcagnntttttttttttttttttttttttttttttt

SEQ ID NO: 4495 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannctagagcanntttttttttttttttttttttttttttttt

SEQ ID NO: 4496 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncttctagcnntttttttttttttttttttttttttttttt

SEQ ID NO: 4497 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngagtaacgnntttttttttttttttttttttttttttttt

SEQ ID NO: 4498 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannctaagaggnntttttttttttttttttttttttttttttt

SEQ ID NO: 4499 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannacgtgtagnntttttttttttttttttttttttttttttt

SEQ ID NO: 4500 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannactacaggnntttttttttttttttttttttttttttttt

SEQ ID NO: 4501 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntacaggtcnntttttttttttttttttttttttttttttt

SEQ ID NO: 4502 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannctcacatgnntttttttttttttttttttttttttttttt

SEQ ID NO: 4503 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannactaggagnntttttttttttttttttttttttttttttt

SEQ ID NO: 4504 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannccatagganntttttttttttttttttttttttttttttt

SEQ ID NO: 4505 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannggagaatcnntttttttttttttttttttttttttttttt

SEQ ID NO: 4506 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngccaagaanntttttttttttttttttttttttttttttt

SEQ ID NO: 4507 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannaaggcaagnntttttttttttttttttttttttttttttt

SEQ ID NO: 4508 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannaatgtcgcnntttttttttttttttttttttttttttttt

SEQ ID NO: 4509 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannatggaaccnntttttttttttttttttttttttttttttt

SEQ ID NO: 4510 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannagaggcatnntttttttttttttttttttttttttttttt

SEQ ID NO: 4511 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntgcatagcnntttttttttttttttttttttttttttttt

SEQ ID NO: 4512 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannctaacgganntttttttttttttttttttttttttttttt

SEQ ID NO: 4513 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntatcgaggnntttttttttttttttttttttttttttttt

SEQ ID NO: 4514 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncatagcctnntttttttttttttttttttttttttttttt

SEQ ID NO: 4515 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannatcgagacnntttttttttttttttttttttttttttttt

SEQ ID NO: 4516 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannggaagagtnntttttttttttttttttttttttttttttt

SEQ ID NO: 4517 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannccaagtagnntttttttttttttttttttttttttttttt

SEQ ID NO: 4518 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannctgaacagnntttttttttttttttttttttttttttttt

SEQ ID NO: 4519 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngtaggttcnntttttttttttttttttttttttttttttt

SEQ ID NO: 4520 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngtatggacnntttttttttttttttttttttttttttttt

SEQ ID NO: 4521 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntcgcaacanntttttttttttttttttttttttttttttt

SEQ ID NO: 4522 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannccgctaatnntttttttttttttttttttttttttttttt

SEQ ID NO: 4523 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngattcgcanntttttttttttttttttttttttttttttt

SEQ ID NO: 4524 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncgatggaanntttttttttttttttttttttttttttttt

SEQ ID NO: 4525 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannagcaagganntttttttttttttttttttttttttttttt

SEQ ID NO: 4526 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncgtagcaanntttttttttttttttttttttttttttttt

SEQ ID NO: 4527 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntggcagtanntttttttttttttttttttttttttttttt

SEQ ID NO: 4528 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncggtagttnntttttttttttttttttttttttttttttt

SEQ ID NO: 4529 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntgacttcgnntttttttttttttttttttttttttttttt

SEQ ID NO: 4530 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngagtgcaanntttttttttttttttttttttttttttttt

SEQ ID NO: 4531 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannacggtaacnntttttttttttttttttttttttttttttt

SEQ ID NO: 4532 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannaagtggtgnntttttttttttttttttttttttttttttt

SEQ ID NO: 4533 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannggagacaanntttttttttttttttttttttttttttttt

SEQ ID NO: 4534 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntcaaggacnntttttttttttttttttttttttttttttt

SEQ ID NO: 4535 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannaagagagcnntttttttttttttttttttttttttttttt

SEQ ID NO: 4536 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncgagagatnntttttttttttttttttttttttttttttt

SEQ ID NO: 4537 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannacagatggnntttttttttttttttttttttttttttttt

SEQ ID NO: 4538 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannaggagtcanntttttttttttttttttttttttttttttt

SEQ ID NO: 4539 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncgtgttacnntttttttttttttttttttttttttttttt

SEQ ID NO: 4540 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntagtgtgcnntttttttttttttttttttttttttttttt

SEQ ID NO: 4541 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannctcatgacnntttttttttttttttttttttttttttttt

SEQ ID NO: 4542 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngtatccagnntttttttttttttttttttttttttttttt

SEQ ID NO: 4543 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannacgcctatnntttttttttttttttttttttttttttttt

SEQ ID NO: 4544 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannaacgacctnntttttttttttttttttttttttttttttt

SEQ ID NO: 4545 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannatcaggctnntttttttttttttttttttttttttttttt

SEQ ID NO: 4546 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncaagttcgnntttttttttttttttttttttttttttttt

SEQ ID NO: 4547 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntagccaganntttttttttttttttttttttttttttttt

SEQ ID NO: 4548 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncaatcacgnntttttttttttttttttttttttttttttt

SEQ ID NO: 4549 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanngcaacaagnntttttttttttttttttttttttttttttt

SEQ ID NO: 4550 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncacgacaanntttttttttttttttttttttttttttttt

SEQ ID NO: 4551 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntacggaganntttttttttttttttttttttttttttttt

SEQ ID NO: 4552 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncgacaaganntttttttttttttttttttttttttttttt

SEQ ID NO: 4553 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncgaagtganntttttttttttttttttttttttttttttt

SEQ ID NO: 4554 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannagctggtanntttttttttttttttttttttttttttttt

SEQ ID NO: 4555 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannaactaggcnntttttttttttttttttttttttttttttt

SEQ ID NO: 4556 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncagcaagtnntttttttttttttttttttttttttttttt

SEQ ID NO: 4557 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannacgaggtanntttttttttttttttttttttttttttttt

SEQ ID NO: 4558 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncatcttccnntttttttttttttttttttttttttttttt

SEQ ID NO: 4559 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncctgaatcnntttttttttttttttttttttttttttttt

SEQ ID NO: 4560 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanntgcagactnntttttttttttttttttttttttttttttt

SEQ ID NO: 4561 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannagatgtggnntttttttttttttttttttttttttttttt

SEQ ID NO: 4562 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannagttcgacnntttttttttttttttttttttttttttttt

SEQ ID NO: 4563 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaannacaacctcnntttttttttttttttttttttttttttttt

SEQ ID NO: 4564 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncatggtagnntttttttttttttttttttttttttttttt

SEQ ID NO: 4565 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncgtatctcnntttttttttttttttttttttttttttttt

SEQ ID NO: 4566 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncctagttcnntttttttttttttttttttttttttttttt

SEQ ID NO: 4567 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtcagaanncaagagtcnntttttttttttttttttttttttttttttt

SEQ ID NO: 4568 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnaatcggcanntttttttttttttttttttttttttttttt

SEQ ID NO: 4569 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntacggcatnntttttttttttttttttttttttttttttt

SEQ ID NO: 4570 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnttggatcgnntttttttttttttttttttttttttttttt

SEQ ID NO: 4571 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntggaacganntttttttttttttttttttttttttttttt

SEQ ID NO: 4572 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnggcaatcanntttttttttttttttttttttttttttttt

SEQ ID NO: 4573 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngaatccganntttttttttttttttttttttttttttttt

SEQ ID NO: 4574 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnttacggtgnntttttttttttttttttttttttttttttt

SEQ ID NO: 4575 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncatatcggnntttttttttttttttttttttttttttttt

SEQ ID NO: 4576 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncttcggtanntttttttttttttttttttttttttttttt

SEQ ID NO: 4577 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntcctaacgnntttttttttttttttttttttttttttttt

SEQ ID NO: 4578 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngtaagccanntttttttttttttttttttttttttttttt

SEQ ID NO: 4579 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntaaggtggnntttttttttttttttttttttttttttttt

SEQ ID NO: 4580 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnggtaagctnntttttttttttttttttttttttttttttt

SEQ ID NO: 4581 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntgtgtcganntttttttttttttttttttttttttttttt

SEQ ID NO: 4582 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngagcatganntttttttttttttttttttttttttttttt

SEQ ID NO: 4583 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntcgaagtcnntttttttttttttttttttttttttttttt

SEQ ID NO: 4584 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnggtgaacanntttttttttttttttttttttttttttttt

SEQ ID NO: 4585 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnacatgcacnntttttttttttttttttttttttttttttt

SEQ ID NO: 4586 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnccaacagtnntttttttttttttttttttttttttttttt

SEQ ID NO: 4587 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnagaacagcnntttttttttttttttttttttttttttttt

SEQ ID NO: 4588 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngaacacgtnntttttttttttttttttttttttttttttt

SEQ ID NO: 4589 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnggtcttcanntttttttttttttttttttttttttttttt

SEQ ID NO: 4590 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnaggttcagnntttttttttttttttttttttttttttttt

SEQ ID NO: 4591 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnctagagcanntttttttttttttttttttttttttttttt

SEQ ID NO: 4592 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncttctagcnntttttttttttttttttttttttttttttt

SEQ ID NO: 4593 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngagtaacgnntttttttttttttttttttttttttttttt

SEQ ID NO: 4594 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnctaagaggnntttttttttttttttttttttttttttttt

SEQ ID NO: 4595 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnacgtgtagnntttttttttttttttttttttttttttttt

SEQ ID NO: 4596 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnactacaggnntttttttttttttttttttttttttttttt

SEQ ID NO: 4597 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntacaggtcnntttttttttttttttttttttttttttttt

SEQ ID NO: 4598 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnctcacatgnntttttttttttttttttttttttttttttt

SEQ ID NO: 4599 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnactaggagnntttttttttttttttttttttttttttttt

SEQ ID NO: 4600 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnccatagganntttttttttttttttttttttttttttttt

SEQ ID NO: 4601 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnggagaatcnntttttttttttttttttttttttttttttt

SEQ ID NO: 4602 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngccaagaanntttttttttttttttttttttttttttttt

SEQ ID NO: 4603 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnaaggcaagnntttttttttttttttttttttttttttttt

SEQ ID NO: 4604 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnaatgtcgcnntttttttttttttttttttttttttttttt

SEQ ID NO: 4605 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnatggaaccnntttttttttttttttttttttttttttttt

SEQ ID NO: 4606 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnagaggcatnntttttttttttttttttttttttttttttt

SEQ ID NO: 4607 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntgcatagcnntttttttttttttttttttttttttttttt

SEQ ID NO: 4608 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnctaacgganntttttttttttttttttttttttttttttt

SEQ ID NO: 4609 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntatcgaggnntttttttttttttttttttttttttttttt

SEQ ID NO: 4610 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncatagcctnntttttttttttttttttttttttttttttt

SEQ ID NO: 4611 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnatcgagacnntttttttttttttttttttttttttttttt

SEQ ID NO: 4612 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnggaagagtnntttttttttttttttttttttttttttttt

SEQ ID NO: 4613 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnccaagtagnntttttttttttttttttttttttttttttt

SEQ ID NO: 4614 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnctgaacagnntttttttttttttttttttttttttttttt

SEQ ID NO: 4615 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngtaggttcnntttttttttttttttttttttttttttttt

SEQ ID NO: 4616 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngtatggacnntttttttttttttttttttttttttttttt

SEQ ID NO: 4617 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntcgcaacanntttttttttttttttttttttttttttttt

SEQ ID NO: 4618 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnccgctaatnntttttttttttttttttttttttttttttt

SEQ ID NO: 4619 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngattcgcanntttttttttttttttttttttttttttttt

SEQ ID NO: 4620 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncgatggaanntttttttttttttttttttttttttttttt

SEQ ID NO: 4621 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnagcaagganntttttttttttttttttttttttttttttt

SEQ ID NO: 4622 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncgtagcaanntttttttttttttttttttttttttttttt

SEQ ID NO: 4623 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntggcagtanntttttttttttttttttttttttttttttt

SEQ ID NO: 4624 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncggtagttnntttttttttttttttttttttttttttttt

SEQ ID NO: 4625 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntgacttcgnntttttttttttttttttttttttttttttt

SEQ ID NO: 4626 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngagtgcaanntttttttttttttttttttttttttttttt

SEQ ID NO: 4627 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnacggtaacnntttttttttttttttttttttttttttttt

SEQ ID NO: 4628 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnaagtggtgnntttttttttttttttttttttttttttttt

SEQ ID NO: 4629 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnggagacaanntttttttttttttttttttttttttttttt

SEQ ID NO: 4630 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntcaaggacnntttttttttttttttttttttttttttttt

SEQ ID NO: 4631 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnaagagagcnntttttttttttttttttttttttttttttt

SEQ ID NO: 4632 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncgagagatnntttttttttttttttttttttttttttttt

SEQ ID NO: 4633 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnacagatggnntttttttttttttttttttttttttttttt

SEQ ID NO: 4634 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnaggagtcanntttttttttttttttttttttttttttttt

SEQ ID NO: 4635 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncgtgttacnntttttttttttttttttttttttttttttt

SEQ ID NO: 4636 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntagtgtgcnntttttttttttttttttttttttttttttt

SEQ ID NO: 4637 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnctcatgacnntttttttttttttttttttttttttttttt

SEQ ID NO: 4638 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngtatccagnntttttttttttttttttttttttttttttt

SEQ ID NO: 4639 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnacgcctatnntttttttttttttttttttttttttttttt

SEQ ID NO: 4640 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnaacgacctnntttttttttttttttttttttttttttttt

SEQ ID NO: 4641 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnatcaggctnntttttttttttttttttttttttttttttt

SEQ ID NO: 4642 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncaagttcgnntttttttttttttttttttttttttttttt

SEQ ID NO: 4643 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntagccaganntttttttttttttttttttttttttttttt

SEQ ID NO: 4644 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncaatcacgnntttttttttttttttttttttttttttttt

SEQ ID NO: 4645 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnngcaacaagnntttttttttttttttttttttttttttttt

SEQ ID NO: 4646 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncacgacaanntttttttttttttttttttttttttttttt

SEQ ID NO: 4647 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntacggaganntttttttttttttttttttttttttttttt

SEQ ID NO: 4648 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncgacaaganntttttttttttttttttttttttttttttt

SEQ ID NO: 4649 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncgaagtganntttttttttttttttttttttttttttttt

SEQ ID NO: 4650 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnagctggtanntttttttttttttttttttttttttttttt

SEQ ID NO: 4651 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnaactaggcnntttttttttttttttttttttttttttttt

SEQ ID NO: 4652 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncagcaagtnntttttttttttttttttttttttttttttt

SEQ ID NO: 4653 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnacgaggtanntttttttttttttttttttttttttttttt

SEQ ID NO: 4654 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncatcttccnntttttttttttttttttttttttttttttt

SEQ ID NO: 4655 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncctgaatcnntttttttttttttttttttttttttttttt

SEQ ID NO: 4656 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnntgcagactnntttttttttttttttttttttttttttttt

SEQ ID NO: 4657 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnagatgtggnntttttttttttttttttttttttttttttt

SEQ ID NO: 4658 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnagttcgacnntttttttttttttttttttttttttttttt

SEQ ID NO: 4659 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnnacaacctcnntttttttttttttttttttttttttttttt

SEQ ID NO: 4660 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncatggtagnntttttttttttttttttttttttttttttt

SEQ ID NO: 4661 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncgtatctcnntttttttttttttttttttttttttttttt

SEQ ID NO: 4662 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncctagttcnntttttttttttttttttttttttttttttt

SEQ ID NO: 4663 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagtcgatnncaagagtcnntttttttttttttttttttttttttttttt

SEQ ID NO: 4664 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnaatcggcanntttttttttttttttttttttttttttttt

SEQ ID NO: 4665 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntacggcatnntttttttttttttttttttttttttttttt

SEQ ID NO: 4666 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnttggatcgnntttttttttttttttttttttttttttttt

SEQ ID NO: 4667 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntggaacganntttttttttttttttttttttttttttttt

SEQ ID NO: 4668 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnggcaatcanntttttttttttttttttttttttttttttt

SEQ ID NO: 4669 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngaatccganntttttttttttttttttttttttttttttt

SEQ ID NO: 4670 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnttacggtgnntttttttttttttttttttttttttttttt

SEQ ID NO: 4671 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncatatcggnntttttttttttttttttttttttttttttt

SEQ ID NO: 4672 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncttcggtanntttttttttttttttttttttttttttttt

SEQ ID NO: 4673 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntcctaacgnntttttttttttttttttttttttttttttt

SEQ ID NO: 4674 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngtaagccanntttttttttttttttttttttttttttttt

SEQ ID NO: 4675 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntaaggtggnntttttttttttttttttttttttttttttt

SEQ ID NO: 4676 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnggtaagctnntttttttttttttttttttttttttttttt

SEQ ID NO: 4677 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntgtgtcganntttttttttttttttttttttttttttttt

SEQ ID NO: 4678 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngagcatganntttttttttttttttttttttttttttttt

SEQ ID NO: 4679 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntcgaagtcnntttttttttttttttttttttttttttttt

SEQ ID NO: 4680 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnggtgaacanntttttttttttttttttttttttttttttt

SEQ ID NO: 4681 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnacatgcacnntttttttttttttttttttttttttttttt

SEQ ID NO: 4682 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnccaacagtnntttttttttttttttttttttttttttttt

SEQ ID NO: 4683 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnagaacagcnntttttttttttttttttttttttttttttt

SEQ ID NO: 4684 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngaacacgtnntttttttttttttttttttttttttttttt

SEQ ID NO: 4685 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnggtcttcanntttttttttttttttttttttttttttttt

SEQ ID NO: 4686 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnaggttcagnntttttttttttttttttttttttttttttt

SEQ ID NO: 4687 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnctagagcanntttttttttttttttttttttttttttttt

SEQ ID NO: 4688 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncttctagcnntttttttttttttttttttttttttttttt

SEQ ID NO: 4689 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngagtaacgnntttttttttttttttttttttttttttttt

SEQ ID NO: 4690 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnctaagaggnntttttttttttttttttttttttttttttt

SEQ ID NO: 4691 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnacgtgtagnntttttttttttttttttttttttttttttt

SEQ ID NO: 4692 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnactacaggnntttttttttttttttttttttttttttttt

SEQ ID NO: 4693 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntacaggtcnntttttttttttttttttttttttttttttt

SEQ ID NO: 4694 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnctcacatgnntttttttttttttttttttttttttttttt

SEQ ID NO: 4695 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnactaggagnntttttttttttttttttttttttttttttt

SEQ ID NO: 4696 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnccatagganntttttttttttttttttttttttttttttt

SEQ ID NO: 4697 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnggagaatcnntttttttttttttttttttttttttttttt

SEQ ID NO: 4698 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngccaagaanntttttttttttttttttttttttttttttt

SEQ ID NO: 4699 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnaaggcaagnntttttttttttttttttttttttttttttt

SEQ ID NO: 4700 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnaatgtcgcnntttttttttttttttttttttttttttttt

SEQ ID NO: 4701 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnatggaaccnntttttttttttttttttttttttttttttt

SEQ ID NO: 4702 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnagaggcatnntttttttttttttttttttttttttttttt

SEQ ID NO: 4703 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntgcatagcnntttttttttttttttttttttttttttttt

SEQ ID NO: 4704 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnctaacgganntttttttttttttttttttttttttttttt

SEQ ID NO: 4705 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntatcgaggnntttttttttttttttttttttttttttttt

SEQ ID NO: 4706 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncatagcctnntttttttttttttttttttttttttttttt

SEQ ID NO: 4707 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnatcgagacnntttttttttttttttttttttttttttttt

SEQ ID NO: 4708 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnggaagagtnntttttttttttttttttttttttttttttt

SEQ ID NO: 4709 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnccaagtagnntttttttttttttttttttttttttttttt

SEQ ID NO: 4710 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnctgaacagnntttttttttttttttttttttttttttttt

SEQ ID NO: 4711 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngtaggttcnntttttttttttttttttttttttttttttt

SEQ ID NO: 4712 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngtatggacnntttttttttttttttttttttttttttttt

SEQ ID NO: 4713 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntcgcaacanntttttttttttttttttttttttttttttt

SEQ ID NO: 4714 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnccgctaatnntttttttttttttttttttttttttttttt

SEQ ID NO: 4715 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngattcgcanntttttttttttttttttttttttttttttt

SEQ ID NO: 4716 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncgatggaanntttttttttttttttttttttttttttttt

SEQ ID NO: 4717 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnagcaagganntttttttttttttttttttttttttttttt

SEQ ID NO: 4718 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncgtagcaanntttttttttttttttttttttttttttttt

SEQ ID NO: 4719 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntggcagtanntttttttttttttttttttttttttttttt

SEQ ID NO: 4720 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncggtagttnntttttttttttttttttttttttttttttt

SEQ ID NO: 4721 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntgacttcgnntttttttttttttttttttttttttttttt

SEQ ID NO: 4722 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngagtgcaanntttttttttttttttttttttttttttttt

SEQ ID NO: 4723 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnacggtaacnntttttttttttttttttttttttttttttt

SEQ ID NO: 4724 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnaagtggtgnntttttttttttttttttttttttttttttt

SEQ ID NO: 4725 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnggagacaanntttttttttttttttttttttttttttttt

SEQ ID NO: 4726 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntcaaggacnntttttttttttttttttttttttttttttt

SEQ ID NO: 4727 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnaagagagcnntttttttttttttttttttttttttttttt

SEQ ID NO: 4728 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncgagagatnntttttttttttttttttttttttttttttt

SEQ ID NO: 4729 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnacagatggnntttttttttttttttttttttttttttttt

SEQ ID NO: 4730 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnaggagtcanntttttttttttttttttttttttttttttt

SEQ ID NO: 4731 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncgtgttacnntttttttttttttttttttttttttttttt

SEQ ID NO: 4732 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntagtgtgcnntttttttttttttttttttttttttttttt

SEQ ID NO: 4733 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnctcatgacnntttttttttttttttttttttttttttttt

SEQ ID NO: 4734 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngtatccagnntttttttttttttttttttttttttttttt

SEQ ID NO: 4735 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnacgcctatnntttttttttttttttttttttttttttttt

SEQ ID NO: 4736 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnaacgacctnntttttttttttttttttttttttttttttt

SEQ ID NO: 4737 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnatcaggctnntttttttttttttttttttttttttttttt

SEQ ID NO: 4738 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncaagttcgnntttttttttttttttttttttttttttttt

SEQ ID NO: 4739 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntagccaganntttttttttttttttttttttttttttttt

SEQ ID NO: 4740 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncaatcacgnntttttttttttttttttttttttttttttt

SEQ ID NO: 4741 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnngcaacaagnntttttttttttttttttttttttttttttt

SEQ ID NO: 4742 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncacgacaanntttttttttttttttttttttttttttttt

SEQ ID NO: 4743 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntacggaganntttttttttttttttttttttttttttttt

SEQ ID NO: 4744 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncgacaaganntttttttttttttttttttttttttttttt

SEQ ID NO: 4745 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncgaagtganntttttttttttttttttttttttttttttt

SEQ ID NO: 4746 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnagctggtanntttttttttttttttttttttttttttttt

SEQ ID NO: 4747 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnaactaggcnntttttttttttttttttttttttttttttt

SEQ ID NO: 4748 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncagcaagtnntttttttttttttttttttttttttttttt

SEQ ID NO: 4749 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnacgaggtanntttttttttttttttttttttttttttttt

SEQ ID NO: 4750 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncatcttccnntttttttttttttttttttttttttttttt

SEQ ID NO: 4751 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncctgaatcnntttttttttttttttttttttttttttttt

SEQ ID NO: 4752 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnntgcagactnntttttttttttttttttttttttttttttt

SEQ ID NO: 4753 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnagatgtggnntttttttttttttttttttttttttttttt

SEQ ID NO: 4754 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnagttcgacnntttttttttttttttttttttttttttttt

SEQ ID NO: 4755 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnnacaacctcnntttttttttttttttttttttttttttttt

SEQ ID NO: 4756 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncatggtagnntttttttttttttttttttttttttttttt

SEQ ID NO: 4757 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncgtatctcnntttttttttttttttttttttttttttttt

SEQ ID NO: 4758 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncctagttcnntttttttttttttttttttttttttttttt

SEQ ID NO: 4759 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngatggtgtnncaagagtcnntttttttttttttttttttttttttttttt

SEQ ID NO: 4760 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnaatcggcanntttttttttttttttttttttttttttttt

SEQ ID NO: 4761 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntacggcatnntttttttttttttttttttttttttttttt

SEQ ID NO: 4762 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnttggatcgnntttttttttttttttttttttttttttttt

SEQ ID NO: 4763 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntggaacganntttttttttttttttttttttttttttttt

SEQ ID NO: 4764 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnggcaatcanntttttttttttttttttttttttttttttt

SEQ ID NO: 4765 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngaatccganntttttttttttttttttttttttttttttt

SEQ ID NO: 4766 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnttacggtgnntttttttttttttttttttttttttttttt

SEQ ID NO: 4767 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncatatcggnntttttttttttttttttttttttttttttt

SEQ ID NO: 4768 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncttcggtanntttttttttttttttttttttttttttttt

SEQ ID NO: 4769 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntcctaacgnntttttttttttttttttttttttttttttt

SEQ ID NO: 4770 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngtaagccanntttttttttttttttttttttttttttttt

SEQ ID NO: 4771 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntaaggtggnntttttttttttttttttttttttttttttt

SEQ ID NO: 4772 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnggtaagctnntttttttttttttttttttttttttttttt

SEQ ID NO: 4773 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntgtgtcganntttttttttttttttttttttttttttttt

SEQ ID NO: 4774 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngagcatganntttttttttttttttttttttttttttttt

SEQ ID NO: 4775 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntcgaagtcnntttttttttttttttttttttttttttttt

SEQ ID NO: 4776 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnggtgaacanntttttttttttttttttttttttttttttt

SEQ ID NO: 4777 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnacatgcacnntttttttttttttttttttttttttttttt

SEQ ID NO: 4778 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnccaacagtnntttttttttttttttttttttttttttttt

SEQ ID NO: 4779 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnagaacagcnntttttttttttttttttttttttttttttt

SEQ ID NO: 4780 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngaacacgtnntttttttttttttttttttttttttttttt

SEQ ID NO: 4781 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnggtcttcanntttttttttttttttttttttttttttttt

SEQ ID NO: 4782 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnaggttcagnntttttttttttttttttttttttttttttt

SEQ ID NO: 4783 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnctagagcanntttttttttttttttttttttttttttttt

SEQ ID NO: 4784 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncttctagcnntttttttttttttttttttttttttttttt

SEQ ID NO: 4785 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngagtaacgnntttttttttttttttttttttttttttttt

SEQ ID NO: 4786 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnctaagaggnntttttttttttttttttttttttttttttt

SEQ ID NO: 4787 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnacgtgtagnntttttttttttttttttttttttttttttt

SEQ ID NO: 4788 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnactacaggnntttttttttttttttttttttttttttttt

SEQ ID NO: 4789 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntacaggtcnntttttttttttttttttttttttttttttt

SEQ ID NO: 4790 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnctcacatgnntttttttttttttttttttttttttttttt

SEQ ID NO: 4791 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnactaggagnntttttttttttttttttttttttttttttt

SEQ ID NO: 4792 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnccatagganntttttttttttttttttttttttttttttt

SEQ ID NO: 4793 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnggagaatcnntttttttttttttttttttttttttttttt

SEQ ID NO: 4794 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngccaagaanntttttttttttttttttttttttttttttt

SEQ ID NO: 4795 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnaaggcaagnntttttttttttttttttttttttttttttt

SEQ ID NO: 4796 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnaatgtcgcnntttttttttttttttttttttttttttttt

SEQ ID NO: 4797 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnatggaaccnntttttttttttttttttttttttttttttt

SEQ ID NO: 4798 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnagaggcatnntttttttttttttttttttttttttttttt

SEQ ID NO: 4799 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntgcatagcnntttttttttttttttttttttttttttttt

SEQ ID NO: 4800 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnctaacgganntttttttttttttttttttttttttttttt

SEQ ID NO: 4801 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntatcgaggnntttttttttttttttttttttttttttttt

SEQ ID NO: 4802 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncatagcctnntttttttttttttttttttttttttttttt

SEQ ID NO: 4803 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnatcgagacnntttttttttttttttttttttttttttttt

SEQ ID NO: 4804 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnggaagagtnntttttttttttttttttttttttttttttt

SEQ ID NO: 4805 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnccaagtagnntttttttttttttttttttttttttttttt

SEQ ID NO: 4806 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnctgaacagnntttttttttttttttttttttttttttttt

SEQ ID NO: 4807 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngtaggttcnntttttttttttttttttttttttttttttt

SEQ ID NO: 4808 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngtatggacnntttttttttttttttttttttttttttttt

SEQ ID NO: 4809 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntcgcaacanntttttttttttttttttttttttttttttt

SEQ ID NO: 4810 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnccgctaatnntttttttttttttttttttttttttttttt

SEQ ID NO: 4811 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngattcgcanntttttttttttttttttttttttttttttt

SEQ ID NO: 4812 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncgatggaanntttttttttttttttttttttttttttttt

SEQ ID NO: 4813 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnagcaagganntttttttttttttttttttttttttttttt

SEQ ID NO: 4814 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncgtagcaanntttttttttttttttttttttttttttttt

SEQ ID NO: 4815 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntggcagtanntttttttttttttttttttttttttttttt

SEQ ID NO: 4816 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncggtagttnntttttttttttttttttttttttttttttt

SEQ ID NO: 4817 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntgacttcgnntttttttttttttttttttttttttttttt

SEQ ID NO: 4818 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngagtgcaanntttttttttttttttttttttttttttttt

SEQ ID NO: 4819 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnacggtaacnntttttttttttttttttttttttttttttt

SEQ ID NO: 4820 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnaagtggtgnntttttttttttttttttttttttttttttt

SEQ ID NO: 4821 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnggagacaanntttttttttttttttttttttttttttttt

SEQ ID NO: 4822 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntcaaggacnntttttttttttttttttttttttttttttt

SEQ ID NO: 4823 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnaagagagcnntttttttttttttttttttttttttttttt

SEQ ID NO: 4824 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncgagagatnntttttttttttttttttttttttttttttt

SEQ ID NO: 4825 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnacagatggnntttttttttttttttttttttttttttttt

SEQ ID NO: 4826 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnaggagtcanntttttttttttttttttttttttttttttt

SEQ ID NO: 4827 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncgtgttacnntttttttttttttttttttttttttttttt

SEQ ID NO: 4828 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntagtgtgcnntttttttttttttttttttttttttttttt

SEQ ID NO: 4829 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnctcatgacnntttttttttttttttttttttttttttttt

SEQ ID NO: 4830 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngtatccagnntttttttttttttttttttttttttttttt

SEQ ID NO: 4831 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnacgcctatnntttttttttttttttttttttttttttttt

SEQ ID NO: 4832 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnaacgacctnntttttttttttttttttttttttttttttt

SEQ ID NO: 4833 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnatcaggctnntttttttttttttttttttttttttttttt

SEQ ID NO: 4834 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncaagttcgnntttttttttttttttttttttttttttttt

SEQ ID NO: 4835 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntagccaganntttttttttttttttttttttttttttttt

SEQ ID NO: 4836 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncaatcacgnntttttttttttttttttttttttttttttt

SEQ ID NO: 4837 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnngcaacaagnntttttttttttttttttttttttttttttt

SEQ ID NO: 4838 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncacgacaanntttttttttttttttttttttttttttttt

SEQ ID NO: 4839 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntacggaganntttttttttttttttttttttttttttttt

SEQ ID NO: 4840 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncgacaaganntttttttttttttttttttttttttttttt

SEQ ID NO: 4841 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncgaagtganntttttttttttttttttttttttttttttt

SEQ ID NO: 4842 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnagctggtanntttttttttttttttttttttttttttttt

SEQ ID NO: 4843 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnaactaggcnntttttttttttttttttttttttttttttt

SEQ ID NO: 4844 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncagcaagtnntttttttttttttttttttttttttttttt

SEQ ID NO: 4845 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnacgaggtanntttttttttttttttttttttttttttttt

SEQ ID NO: 4846 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncatcttccnntttttttttttttttttttttttttttttt

SEQ ID NO: 4847 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncctgaatcnntttttttttttttttttttttttttttttt

SEQ ID NO: 4848 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnntgcagactnntttttttttttttttttttttttttttttt

SEQ ID NO: 4849 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnagatgtggnntttttttttttttttttttttttttttttt

SEQ ID NO: 4850 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnagttcgacnntttttttttttttttttttttttttttttt

SEQ ID NO: 4851 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnnacaacctcnntttttttttttttttttttttttttttttt

SEQ ID NO: 4852 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncatggtagnntttttttttttttttttttttttttttttt

SEQ ID NO: 4853 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncgtatctcnntttttttttttttttttttttttttttttt

SEQ ID NO: 4854 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncctagttcnntttttttttttttttttttttttttttttt

SEQ ID NO: 4855 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagaaggtcnncaagagtcnntttttttttttttttttttttttttttttt

SEQ ID NO: 4856 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnaatcggcanntttttttttttttttttttttttttttttt

SEQ ID NO: 4857 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntacggcatnntttttttttttttttttttttttttttttt

SEQ ID NO: 4858 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnttggatcgnntttttttttttttttttttttttttttttt

SEQ ID NO: 4859 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntggaacganntttttttttttttttttttttttttttttt

SEQ ID NO: 4860 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnggcaatcanntttttttttttttttttttttttttttttt

SEQ ID NO: 4861 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngaatccganntttttttttttttttttttttttttttttt

SEQ ID NO: 4862 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnttacggtgnntttttttttttttttttttttttttttttt

SEQ ID NO: 4863 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncatatcggnntttttttttttttttttttttttttttttt

SEQ ID NO: 4864 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncttcggtanntttttttttttttttttttttttttttttt

SEQ ID NO: 4865 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntcctaacgnntttttttttttttttttttttttttttttt

SEQ ID NO: 4866 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngtaagccanntttttttttttttttttttttttttttttt

SEQ ID NO: 4867 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntaaggtggnntttttttttttttttttttttttttttttt

SEQ ID NO: 4868 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnggtaagctnntttttttttttttttttttttttttttttt

SEQ ID NO: 4869 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntgtgtcganntttttttttttttttttttttttttttttt

SEQ ID NO: 4870 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngagcatganntttttttttttttttttttttttttttttt

SEQ ID NO: 4871 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntcgaagtcnntttttttttttttttttttttttttttttt

SEQ ID NO: 4872 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnggtgaacanntttttttttttttttttttttttttttttt

SEQ ID NO: 4873 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnacatgcacnntttttttttttttttttttttttttttttt

SEQ ID NO: 4874 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnccaacagtnntttttttttttttttttttttttttttttt

SEQ ID NO: 4875 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnagaacagcnntttttttttttttttttttttttttttttt

SEQ ID NO: 4876 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngaacacgtnntttttttttttttttttttttttttttttt

SEQ ID NO: 4877 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnggtcttcanntttttttttttttttttttttttttttttt

SEQ ID NO: 4878 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnaggttcagnntttttttttttttttttttttttttttttt

SEQ ID NO: 4879 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnctagagcanntttttttttttttttttttttttttttttt

SEQ ID NO: 4880 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncttctagcnntttttttttttttttttttttttttttttt

SEQ ID NO: 4881 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngagtaacgnntttttttttttttttttttttttttttttt

SEQ ID NO: 4882 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnctaagaggnntttttttttttttttttttttttttttttt

SEQ ID NO: 4883 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnacgtgtagnntttttttttttttttttttttttttttttt

SEQ ID NO: 4884 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnactacaggnntttttttttttttttttttttttttttttt

SEQ ID NO: 4885 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntacaggtcnntttttttttttttttttttttttttttttt

SEQ ID NO: 4886 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnctcacatgnntttttttttttttttttttttttttttttt

SEQ ID NO: 4887 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnactaggagnntttttttttttttttttttttttttttttt

SEQ ID NO: 4888 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnccatagganntttttttttttttttttttttttttttttt

SEQ ID NO: 4889 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnggagaatcnntttttttttttttttttttttttttttttt

SEQ ID NO: 4890 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngccaagaanntttttttttttttttttttttttttttttt

SEQ ID NO: 4891 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnaaggcaagnntttttttttttttttttttttttttttttt

SEQ ID NO: 4892 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnaatgtcgcnntttttttttttttttttttttttttttttt

SEQ ID NO: 4893 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnatggaaccnntttttttttttttttttttttttttttttt

SEQ ID NO: 4894 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnagaggcatnntttttttttttttttttttttttttttttt

SEQ ID NO: 4895 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntgcatagcnntttttttttttttttttttttttttttttt

SEQ ID NO: 4896 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnctaacgganntttttttttttttttttttttttttttttt

SEQ ID NO: 4897 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntatcgaggnntttttttttttttttttttttttttttttt

SEQ ID NO: 4898 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncatagcctnntttttttttttttttttttttttttttttt

SEQ ID NO: 4899 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnatcgagacnntttttttttttttttttttttttttttttt

SEQ ID NO: 4900 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnggaagagtnntttttttttttttttttttttttttttttt

SEQ ID NO: 4901 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnccaagtagnntttttttttttttttttttttttttttttt

SEQ ID NO: 4902 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnctgaacagnntttttttttttttttttttttttttttttt

SEQ ID NO: 4903 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngtaggttcnntttttttttttttttttttttttttttttt

SEQ ID NO: 4904 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngtatggacnntttttttttttttttttttttttttttttt

SEQ ID NO: 4905 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntcgcaacanntttttttttttttttttttttttttttttt

SEQ ID NO: 4906 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnccgctaatnntttttttttttttttttttttttttttttt

SEQ ID NO: 4907 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngattcgcanntttttttttttttttttttttttttttttt

SEQ ID NO: 4908 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncgatggaanntttttttttttttttttttttttttttttt

SEQ ID NO: 4909 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnagcaagganntttttttttttttttttttttttttttttt

SEQ ID NO: 4910 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncgtagcaanntttttttttttttttttttttttttttttt

SEQ ID NO: 4911 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntggcagtanntttttttttttttttttttttttttttttt

SEQ ID NO: 4912 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncggtagttnntttttttttttttttttttttttttttttt

SEQ ID NO: 4913 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntgacttcgnntttttttttttttttttttttttttttttt

SEQ ID NO: 4914 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngagtgcaanntttttttttttttttttttttttttttttt

SEQ ID NO: 4915 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnacggtaacnntttttttttttttttttttttttttttttt

SEQ ID NO: 4916 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnaagtggtgnntttttttttttttttttttttttttttttt

SEQ ID NO: 4917 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnggagacaanntttttttttttttttttttttttttttttt

SEQ ID NO: 4918 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntcaaggacnntttttttttttttttttttttttttttttt

SEQ ID NO: 4919 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnaagagagcnntttttttttttttttttttttttttttttt

SEQ ID NO: 4920 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncgagagatnntttttttttttttttttttttttttttttt

SEQ ID NO: 4921 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnacagatggnntttttttttttttttttttttttttttttt

SEQ ID NO: 4922 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnaggagtcanntttttttttttttttttttttttttttttt

SEQ ID NO: 4923 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncgtgttacnntttttttttttttttttttttttttttttt

SEQ ID NO: 4924 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntagtgtgcnntttttttttttttttttttttttttttttt

SEQ ID NO: 4925 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnctcatgacnntttttttttttttttttttttttttttttt

SEQ ID NO: 4926 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngtatccagnntttttttttttttttttttttttttttttt

SEQ ID NO: 4927 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnacgcctatnntttttttttttttttttttttttttttttt

SEQ ID NO: 4928 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnaacgacctnntttttttttttttttttttttttttttttt

SEQ ID NO: 4929 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnatcaggctnntttttttttttttttttttttttttttttt

SEQ ID NO: 4930 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncaagttcgnntttttttttttttttttttttttttttttt

SEQ ID NO: 4931 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntagccaganntttttttttttttttttttttttttttttt

SEQ ID NO: 4932 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncaatcacgnntttttttttttttttttttttttttttttt

SEQ ID NO: 4933 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnngcaacaagnntttttttttttttttttttttttttttttt

SEQ ID NO: 4934 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncacgacaanntttttttttttttttttttttttttttttt

SEQ ID NO: 4935 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntacggaganntttttttttttttttttttttttttttttt

SEQ ID NO: 4936 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncgacaaganntttttttttttttttttttttttttttttt

SEQ ID NO: 4937 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncgaagtganntttttttttttttttttttttttttttttt

SEQ ID NO: 4938 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnagctggtanntttttttttttttttttttttttttttttt

SEQ ID NO: 4939 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnaactaggcnntttttttttttttttttttttttttttttt

SEQ ID NO: 4940 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncagcaagtnntttttttttttttttttttttttttttttt

SEQ ID NO: 4941 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnacgaggtanntttttttttttttttttttttttttttttt

SEQ ID NO: 4942 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncatcttccnntttttttttttttttttttttttttttttt

SEQ ID NO: 4943 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncctgaatcnntttttttttttttttttttttttttttttt

SEQ ID NO: 4944 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnntgcagactnntttttttttttttttttttttttttttttt

SEQ ID NO: 4945 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnagatgtggnntttttttttttttttttttttttttttttt

SEQ ID NO: 4946 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnagttcgacnntttttttttttttttttttttttttttttt

SEQ ID NO: 4947 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnnacaacctcnntttttttttttttttttttttttttttttt

SEQ ID NO: 4948 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncatggtagnntttttttttttttttttttttttttttttt

SEQ ID NO: 4949 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncgtatctcnntttttttttttttttttttttttttttttt

SEQ ID NO: 4950 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncctagttcnntttttttttttttttttttttttttttttt

SEQ ID NO: 4951 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaggatgacnncaagagtcnntttttttttttttttttttttttttttttt

SEQ ID NO: 4952 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannaatcggcanntttttttttttttttttttttttttttttt

SEQ ID NO: 4953 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntacggcatnntttttttttttttttttttttttttttttt

SEQ ID NO: 4954 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannttggatcgnntttttttttttttttttttttttttttttt

SEQ ID NO: 4955 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntggaacganntttttttttttttttttttttttttttttt

SEQ ID NO: 4956 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannggcaatcanntttttttttttttttttttttttttttttt

SEQ ID NO: 4957 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngaatccganntttttttttttttttttttttttttttttt

SEQ ID NO: 4958 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannttacggtgnntttttttttttttttttttttttttttttt

SEQ ID NO: 4959 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncatatcggnntttttttttttttttttttttttttttttt

SEQ ID NO: 4960 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncttcggtanntttttttttttttttttttttttttttttt

SEQ ID NO: 4961 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntcctaacgnntttttttttttttttttttttttttttttt

SEQ ID NO: 4962 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngtaagccanntttttttttttttttttttttttttttttt

SEQ ID NO: 4963 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntaaggtggnntttttttttttttttttttttttttttttt

SEQ ID NO: 4964 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannggtaagctnntttttttttttttttttttttttttttttt

SEQ ID NO: 4965 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntgtgtcganntttttttttttttttttttttttttttttt

SEQ ID NO: 4966 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngagcatganntttttttttttttttttttttttttttttt

SEQ ID NO: 4967 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntcgaagtcnntttttttttttttttttttttttttttttt

SEQ ID NO: 4968 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannggtgaacanntttttttttttttttttttttttttttttt

SEQ ID NO: 4969 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannacatgcacnntttttttttttttttttttttttttttttt

SEQ ID NO: 4970 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannccaacagtnntttttttttttttttttttttttttttttt

SEQ ID NO: 4971 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannagaacagcnntttttttttttttttttttttttttttttt

SEQ ID NO: 4972 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngaacacgtnntttttttttttttttttttttttttttttt

SEQ ID NO: 4973 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannggtcttcanntttttttttttttttttttttttttttttt

SEQ ID NO: 4974 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannaggttcagnntttttttttttttttttttttttttttttt

SEQ ID NO: 4975 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannctagagcanntttttttttttttttttttttttttttttt

SEQ ID NO: 4976 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncttctagcnntttttttttttttttttttttttttttttt

SEQ ID NO: 4977 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngagtaacgnntttttttttttttttttttttttttttttt

SEQ ID NO: 4978 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannctaagaggnntttttttttttttttttttttttttttttt

SEQ ID NO: 4979 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannacgtgtagnntttttttttttttttttttttttttttttt

SEQ ID NO: 4980 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannactacaggnntttttttttttttttttttttttttttttt

SEQ ID NO: 4981 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntacaggtcnntttttttttttttttttttttttttttttt

SEQ ID NO: 4982 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannctcacatgnntttttttttttttttttttttttttttttt

SEQ ID NO: 4983 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannactaggagnntttttttttttttttttttttttttttttt

SEQ ID NO: 4984 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannccatagganntttttttttttttttttttttttttttttt

SEQ ID NO: 4985 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannggagaatcnntttttttttttttttttttttttttttttt

SEQ ID NO: 4986 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngccaagaanntttttttttttttttttttttttttttttt

SEQ ID NO: 4987 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannaaggcaagnntttttttttttttttttttttttttttttt

SEQ ID NO: 4988 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannaatgtcgcnntttttttttttttttttttttttttttttt

SEQ ID NO: 4989 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannatggaaccnntttttttttttttttttttttttttttttt

SEQ ID NO: 4990 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannagaggcatnntttttttttttttttttttttttttttttt

SEQ ID NO: 4991 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntgcatagcnntttttttttttttttttttttttttttttt

SEQ ID NO: 4992 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannctaacgganntttttttttttttttttttttttttttttt

SEQ ID NO: 4993 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntatcgaggnntttttttttttttttttttttttttttttt

SEQ ID NO: 4994 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncatagcctnntttttttttttttttttttttttttttttt

SEQ ID NO: 4995 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannatcgagacnntttttttttttttttttttttttttttttt

SEQ ID NO: 4996 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannggaagagtnntttttttttttttttttttttttttttttt

SEQ ID NO: 4997 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannccaagtagnntttttttttttttttttttttttttttttt

SEQ ID NO: 4998 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannctgaacagnntttttttttttttttttttttttttttttt

SEQ ID NO: 4999 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngtaggttcnntttttttttttttttttttttttttttttt

SEQ ID NO: 5000 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngtatggacnntttttttttttttttttttttttttttttt

SEQ ID NO: 5001 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntcgcaacanntttttttttttttttttttttttttttttt

SEQ ID NO: 5002 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannccgctaatnntttttttttttttttttttttttttttttt

SEQ ID NO: 5003 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngattcgcanntttttttttttttttttttttttttttttt

SEQ ID NO: 5004 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncgatggaanntttttttttttttttttttttttttttttt

SEQ ID NO: 5005 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannagcaagganntttttttttttttttttttttttttttttt

SEQ ID NO: 5006 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncgtagcaanntttttttttttttttttttttttttttttt

SEQ ID NO: 5007 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntggcagtanntttttttttttttttttttttttttttttt

SEQ ID NO: 5008 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncggtagttnntttttttttttttttttttttttttttttt

SEQ ID NO: 5009 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntgacttcgnntttttttttttttttttttttttttttttt

SEQ ID NO: 5010 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngagtgcaanntttttttttttttttttttttttttttttt

SEQ ID NO: 5011 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannacggtaacnntttttttttttttttttttttttttttttt

SEQ ID NO: 5012 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannaagtggtgnntttttttttttttttttttttttttttttt

SEQ ID NO: 5013 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannggagacaanntttttttttttttttttttttttttttttt

SEQ ID NO: 5014 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntcaaggacnntttttttttttttttttttttttttttttt

SEQ ID NO: 5015 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannaagagagcnntttttttttttttttttttttttttttttt

SEQ ID NO: 5016 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncgagagatnntttttttttttttttttttttttttttttt

SEQ ID NO: 5017 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannacagatggnntttttttttttttttttttttttttttttt

SEQ ID NO: 5018 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannaggagtcanntttttttttttttttttttttttttttttt

SEQ ID NO: 5019 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncgtgttacnntttttttttttttttttttttttttttttt

SEQ ID NO: 5020 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntagtgtgcnntttttttttttttttttttttttttttttt

SEQ ID NO: 5021 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannctcatgacnntttttttttttttttttttttttttttttt

SEQ ID NO: 5022 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngtatccagnntttttttttttttttttttttttttttttt

SEQ ID NO: 5023 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannacgcctatnntttttttttttttttttttttttttttttt

SEQ ID NO: 5024 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannaacgacctnntttttttttttttttttttttttttttttt

SEQ ID NO: 5025 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannatcaggctnntttttttttttttttttttttttttttttt

SEQ ID NO: 5026 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncaagttcgnntttttttttttttttttttttttttttttt

SEQ ID NO: 5027 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntagccaganntttttttttttttttttttttttttttttt

SEQ ID NO: 5028 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncaatcacgnntttttttttttttttttttttttttttttt

SEQ ID NO: 5029 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanngcaacaagnntttttttttttttttttttttttttttttt

SEQ ID NO: 5030 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncacgacaanntttttttttttttttttttttttttttttt

SEQ ID NO: 5031 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntacggaganntttttttttttttttttttttttttttttt

SEQ ID NO: 5032 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncgacaaganntttttttttttttttttttttttttttttt

SEQ ID NO: 5033 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncgaagtganntttttttttttttttttttttttttttttt

SEQ ID NO: 5034 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannagctggtanntttttttttttttttttttttttttttttt

SEQ ID NO: 5035 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannaactaggcnntttttttttttttttttttttttttttttt

SEQ ID NO: 5036 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncagcaagtnntttttttttttttttttttttttttttttt

SEQ ID NO: 5037 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannacgaggtanntttttttttttttttttttttttttttttt

SEQ ID NO: 5038 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncatcttccnntttttttttttttttttttttttttttttt

SEQ ID NO: 5039 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncctgaatcnntttttttttttttttttttttttttttttt

SEQ ID NO: 5040 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanntgcagactnntttttttttttttttttttttttttttttt

SEQ ID NO: 5041 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannagatgtggnntttttttttttttttttttttttttttttt

SEQ ID NO: 5042 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannagttcgacnntttttttttttttttttttttttttttttt

SEQ ID NO: 5043 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtannacaacctcnntttttttttttttttttttttttttttttt

SEQ ID NO: 5044 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncatggtagnntttttttttttttttttttttttttttttt

SEQ ID NO: 5045 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncgtatctcnntttttttttttttttttttttttttttttt

SEQ ID NO: 5046 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncctagttcnntttttttttttttttttttttttttttttt

SEQ ID NO: 5047 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtaggtanncaagagtcnntttttttttttttttttttttttttttttt

SEQ ID NO: 5048 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnaatcggcanntttttttttttttttttttttttttttttt

SEQ ID NO: 5049 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntacggcatnntttttttttttttttttttttttttttttt

SEQ ID NO: 5050 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnttggatcgnntttttttttttttttttttttttttttttt

SEQ ID NO: 5051 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntggaacganntttttttttttttttttttttttttttttt

SEQ ID NO: 5052 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnggcaatcanntttttttttttttttttttttttttttttt

SEQ ID NO: 5053 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngaatccganntttttttttttttttttttttttttttttt

SEQ ID NO: 5054 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnttacggtgnntttttttttttttttttttttttttttttt

SEQ ID NO: 5055 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncatatcggnntttttttttttttttttttttttttttttt

SEQ ID NO: 5056 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncttcggtanntttttttttttttttttttttttttttttt

SEQ ID NO: 5057 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntcctaacgnntttttttttttttttttttttttttttttt

SEQ ID NO: 5058 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngtaagccanntttttttttttttttttttttttttttttt

SEQ ID NO: 5059 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntaaggtggnntttttttttttttttttttttttttttttt

SEQ ID NO: 5060 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnggtaagctnntttttttttttttttttttttttttttttt

SEQ ID NO: 5061 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntgtgtcganntttttttttttttttttttttttttttttt

SEQ ID NO: 5062 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngagcatganntttttttttttttttttttttttttttttt

SEQ ID NO: 5063 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntcgaagtcnntttttttttttttttttttttttttttttt

SEQ ID NO: 5064 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnggtgaacanntttttttttttttttttttttttttttttt

SEQ ID NO: 5065 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnacatgcacnntttttttttttttttttttttttttttttt

SEQ ID NO: 5066 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnccaacagtnntttttttttttttttttttttttttttttt

SEQ ID NO: 5067 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnagaacagcnntttttttttttttttttttttttttttttt

SEQ ID NO: 5068 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngaacacgtnntttttttttttttttttttttttttttttt

SEQ ID NO: 5069 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnggtcttcanntttttttttttttttttttttttttttttt

SEQ ID NO: 5070 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnaggttcagnntttttttttttttttttttttttttttttt

SEQ ID NO: 5071 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnctagagcanntttttttttttttttttttttttttttttt

SEQ ID NO: 5072 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncttctagcnntttttttttttttttttttttttttttttt

SEQ ID NO: 5073 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngagtaacgnntttttttttttttttttttttttttttttt

SEQ ID NO: 5074 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnctaagaggnntttttttttttttttttttttttttttttt

SEQ ID NO: 5075 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnacgtgtagnntttttttttttttttttttttttttttttt

SEQ ID NO: 5076 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnactacaggnntttttttttttttttttttttttttttttt

SEQ ID NO: 5077 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntacaggtcnntttttttttttttttttttttttttttttt

SEQ ID NO: 5078 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnctcacatgnntttttttttttttttttttttttttttttt

SEQ ID NO: 5079 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnactaggagnntttttttttttttttttttttttttttttt

SEQ ID NO: 5080 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnccatagganntttttttttttttttttttttttttttttt

SEQ ID NO: 5081 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnggagaatcnntttttttttttttttttttttttttttttt

SEQ ID NO: 5082 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngccaagaanntttttttttttttttttttttttttttttt

SEQ ID NO: 5083 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnaaggcaagnntttttttttttttttttttttttttttttt

SEQ ID NO: 5084 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnaatgtcgcnntttttttttttttttttttttttttttttt

SEQ ID NO: 5085 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnatggaaccnntttttttttttttttttttttttttttttt

SEQ ID NO: 5086 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnagaggcatnntttttttttttttttttttttttttttttt

SEQ ID NO: 5087 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntgcatagcnntttttttttttttttttttttttttttttt

SEQ ID NO: 5088 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnctaacgganntttttttttttttttttttttttttttttt

SEQ ID NO: 5089 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntatcgaggnntttttttttttttttttttttttttttttt

SEQ ID NO: 5090 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncatagcctnntttttttttttttttttttttttttttttt

SEQ ID NO: 5091 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnatcgagacnntttttttttttttttttttttttttttttt

SEQ ID NO: 5092 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnggaagagtnntttttttttttttttttttttttttttttt

SEQ ID NO: 5093 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnccaagtagnntttttttttttttttttttttttttttttt

SEQ ID NO: 5094 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnctgaacagnntttttttttttttttttttttttttttttt

SEQ ID NO: 5095 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngtaggttcnntttttttttttttttttttttttttttttt

SEQ ID NO: 5096 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngtatggacnntttttttttttttttttttttttttttttt

SEQ ID NO: 5097 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntcgcaacanntttttttttttttttttttttttttttttt

SEQ ID NO: 5098 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnccgctaatnntttttttttttttttttttttttttttttt

SEQ ID NO: 5099 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngattcgcanntttttttttttttttttttttttttttttt

SEQ ID NO: 5100 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncgatggaanntttttttttttttttttttttttttttttt

SEQ ID NO: 5101 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnagcaagganntttttttttttttttttttttttttttttt

SEQ ID NO: 5102 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncgtagcaanntttttttttttttttttttttttttttttt

SEQ ID NO: 5103 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntggcagtanntttttttttttttttttttttttttttttt

SEQ ID NO: 5104 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncggtagttnntttttttttttttttttttttttttttttt

SEQ ID NO: 5105 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntgacttcgnntttttttttttttttttttttttttttttt

SEQ ID NO: 5106 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngagtgcaanntttttttttttttttttttttttttttttt

SEQ ID NO: 5107 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnacggtaacnntttttttttttttttttttttttttttttt

SEQ ID NO: 5108 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnaagtggtgnntttttttttttttttttttttttttttttt

SEQ ID NO: 5109 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnggagacaanntttttttttttttttttttttttttttttt

SEQ ID NO: 5110 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntcaaggacnntttttttttttttttttttttttttttttt

SEQ ID NO: 5111 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnaagagagcnntttttttttttttttttttttttttttttt

SEQ ID NO: 5112 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncgagagatnntttttttttttttttttttttttttttttt

SEQ ID NO: 5113 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnacagatggnntttttttttttttttttttttttttttttt

SEQ ID NO: 5114 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnaggagtcanntttttttttttttttttttttttttttttt

SEQ ID NO: 5115 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncgtgttacnntttttttttttttttttttttttttttttt

SEQ ID NO: 5116 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntagtgtgcnntttttttttttttttttttttttttttttt

SEQ ID NO: 5117 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnctcatgacnntttttttttttttttttttttttttttttt

SEQ ID NO: 5118 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngtatccagnntttttttttttttttttttttttttttttt

SEQ ID NO: 5119 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnacgcctatnntttttttttttttttttttttttttttttt

SEQ ID NO: 5120 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnaacgacctnntttttttttttttttttttttttttttttt

SEQ ID NO: 5121 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnatcaggctnntttttttttttttttttttttttttttttt

SEQ ID NO: 5122 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncaagttcgnntttttttttttttttttttttttttttttt

SEQ ID NO: 5123 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntagccaganntttttttttttttttttttttttttttttt

SEQ ID NO: 5124 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncaatcacgnntttttttttttttttttttttttttttttt

SEQ ID NO: 5125 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnngcaacaagnntttttttttttttttttttttttttttttt

SEQ ID NO: 5126 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncacgacaanntttttttttttttttttttttttttttttt

SEQ ID NO: 5127 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntacggaganntttttttttttttttttttttttttttttt

SEQ ID NO: 5128 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncgacaaganntttttttttttttttttttttttttttttt

SEQ ID NO: 5129 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncgaagtganntttttttttttttttttttttttttttttt

SEQ ID NO: 5130 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnagctggtanntttttttttttttttttttttttttttttt

SEQ ID NO: 5131 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnaactaggcnntttttttttttttttttttttttttttttt

SEQ ID NO: 5132 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncagcaagtnntttttttttttttttttttttttttttttt

SEQ ID NO: 5133 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnacgaggtanntttttttttttttttttttttttttttttt

SEQ ID NO: 5134 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncatcttccnntttttttttttttttttttttttttttttt

SEQ ID NO: 5135 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncctgaatcnntttttttttttttttttttttttttttttt

SEQ ID NO: 5136 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnntgcagactnntttttttttttttttttttttttttttttt

SEQ ID NO: 5137 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnagatgtggnntttttttttttttttttttttttttttttt

SEQ ID NO: 5138 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnagttcgacnntttttttttttttttttttttttttttttt

SEQ ID NO: 5139 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnnacaacctcnntttttttttttttttttttttttttttttt

SEQ ID NO: 5140 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncatggtagnntttttttttttttttttttttttttttttt

SEQ ID NO: 5141 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncgtatctcnntttttttttttttttttttttttttttttt

SEQ ID NO: 5142 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncctagttcnntttttttttttttttttttttttttttttt

SEQ ID NO: 5143 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngacaagtgnncaagagtcnntttttttttttttttttttttttttttttt

SEQ ID NO: 5144 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnaatcggcanntttttttttttttttttttttttttttttt

SEQ ID NO: 5145 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntacggcatnntttttttttttttttttttttttttttttt

SEQ ID NO: 5146 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnttggatcgnntttttttttttttttttttttttttttttt

SEQ ID NO: 5147 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntggaacganntttttttttttttttttttttttttttttt

SEQ ID NO: 5148 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnggcaatcanntttttttttttttttttttttttttttttt

SEQ ID NO: 5149 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngaatccganntttttttttttttttttttttttttttttt

SEQ ID NO: 5150 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnttacggtgnntttttttttttttttttttttttttttttt

SEQ ID NO: 5151 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncatatcggnntttttttttttttttttttttttttttttt

SEQ ID NO: 5152 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncttcggtanntttttttttttttttttttttttttttttt

SEQ ID NO: 5153 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntcctaacgnntttttttttttttttttttttttttttttt

SEQ ID NO: 5154 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngtaagccanntttttttttttttttttttttttttttttt

SEQ ID NO: 5155 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntaaggtggnntttttttttttttttttttttttttttttt

SEQ ID NO: 5156 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnggtaagctnntttttttttttttttttttttttttttttt

SEQ ID NO: 5157 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntgtgtcganntttttttttttttttttttttttttttttt

SEQ ID NO: 5158 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngagcatganntttttttttttttttttttttttttttttt

SEQ ID NO: 5159 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntcgaagtcnntttttttttttttttttttttttttttttt

SEQ ID NO: 5160 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnggtgaacanntttttttttttttttttttttttttttttt

SEQ ID NO: 5161 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnacatgcacnntttttttttttttttttttttttttttttt

SEQ ID NO: 5162 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnccaacagtnntttttttttttttttttttttttttttttt

SEQ ID NO: 5163 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnagaacagcnntttttttttttttttttttttttttttttt

SEQ ID NO: 5164 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngaacacgtnntttttttttttttttttttttttttttttt

SEQ ID NO: 5165 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnggtcttcanntttttttttttttttttttttttttttttt

SEQ ID NO: 5166 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnaggttcagnntttttttttttttttttttttttttttttt

SEQ ID NO: 5167 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnctagagcanntttttttttttttttttttttttttttttt

SEQ ID NO: 5168 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncttctagcnntttttttttttttttttttttttttttttt

SEQ ID NO: 5169 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngagtaacgnntttttttttttttttttttttttttttttt

SEQ ID NO: 5170 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnctaagaggnntttttttttttttttttttttttttttttt

SEQ ID NO: 5171 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnacgtgtagnntttttttttttttttttttttttttttttt

SEQ ID NO: 5172 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnactacaggnntttttttttttttttttttttttttttttt

SEQ ID NO: 5173 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntacaggtcnntttttttttttttttttttttttttttttt

SEQ ID NO: 5174 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnctcacatgnntttttttttttttttttttttttttttttt

SEQ ID NO: 5175 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnactaggagnntttttttttttttttttttttttttttttt

SEQ ID NO: 5176 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnccatagganntttttttttttttttttttttttttttttt

SEQ ID NO: 5177 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnggagaatcnntttttttttttttttttttttttttttttt

SEQ ID NO: 5178 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngccaagaanntttttttttttttttttttttttttttttt

SEQ ID NO: 5179 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnaaggcaagnntttttttttttttttttttttttttttttt

SEQ ID NO: 5180 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnaatgtcgcnntttttttttttttttttttttttttttttt

SEQ ID NO: 5181 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnatggaaccnntttttttttttttttttttttttttttttt

SEQ ID NO: 5182 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnagaggcatnntttttttttttttttttttttttttttttt

SEQ ID NO: 5183 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntgcatagcnntttttttttttttttttttttttttttttt

SEQ ID NO: 5184 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnctaacgganntttttttttttttttttttttttttttttt

SEQ ID NO: 5185 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntatcgaggnntttttttttttttttttttttttttttttt

SEQ ID NO: 5186 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncatagcctnntttttttttttttttttttttttttttttt

SEQ ID NO: 5187 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnatcgagacnntttttttttttttttttttttttttttttt

SEQ ID NO: 5188 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnggaagagtnntttttttttttttttttttttttttttttt

SEQ ID NO: 5189 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnccaagtagnntttttttttttttttttttttttttttttt

SEQ ID NO: 5190 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnctgaacagnntttttttttttttttttttttttttttttt

SEQ ID NO: 5191 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngtaggttcnntttttttttttttttttttttttttttttt

SEQ ID NO: 5192 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngtatggacnntttttttttttttttttttttttttttttt

SEQ ID NO: 5193 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntcgcaacanntttttttttttttttttttttttttttttt

SEQ ID NO: 5194 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnccgctaatnntttttttttttttttttttttttttttttt

SEQ ID NO: 5195 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngattcgcanntttttttttttttttttttttttttttttt

SEQ ID NO: 5196 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncgatggaanntttttttttttttttttttttttttttttt

SEQ ID NO: 5197 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnagcaagganntttttttttttttttttttttttttttttt

SEQ ID NO: 5198 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncgtagcaanntttttttttttttttttttttttttttttt

SEQ ID NO: 5199 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntggcagtanntttttttttttttttttttttttttttttt

SEQ ID NO: 5200 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncggtagttnntttttttttttttttttttttttttttttt

SEQ ID NO: 5201 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntgacttcgnntttttttttttttttttttttttttttttt

SEQ ID NO: 5202 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngagtgcaanntttttttttttttttttttttttttttttt

SEQ ID NO: 5203 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnacggtaacnntttttttttttttttttttttttttttttt

SEQ ID NO: 5204 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnaagtggtgnntttttttttttttttttttttttttttttt

SEQ ID NO: 5205 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnggagacaanntttttttttttttttttttttttttttttt

SEQ ID NO: 5206 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntcaaggacnntttttttttttttttttttttttttttttt

SEQ ID NO: 5207 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnaagagagcnntttttttttttttttttttttttttttttt

SEQ ID NO: 5208 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncgagagatnntttttttttttttttttttttttttttttt

SEQ ID NO: 5209 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnacagatggnntttttttttttttttttttttttttttttt

SEQ ID NO: 5210 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnaggagtcanntttttttttttttttttttttttttttttt

SEQ ID NO: 5211 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncgtgttacnntttttttttttttttttttttttttttttt

SEQ ID NO: 5212 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntagtgtgcnntttttttttttttttttttttttttttttt

SEQ ID NO: 5213 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnctcatgacnntttttttttttttttttttttttttttttt

SEQ ID NO: 5214 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngtatccagnntttttttttttttttttttttttttttttt

SEQ ID NO: 5215 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnacgcctatnntttttttttttttttttttttttttttttt

SEQ ID NO: 5216 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnaacgacctnntttttttttttttttttttttttttttttt

SEQ ID NO: 5217 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnatcaggctnntttttttttttttttttttttttttttttt

SEQ ID NO: 5218 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncaagttcgnntttttttttttttttttttttttttttttt

SEQ ID NO: 5219 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntagccaganntttttttttttttttttttttttttttttt

SEQ ID NO: 5220 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncaatcacgnntttttttttttttttttttttttttttttt

SEQ ID NO: 5221 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnngcaacaagnntttttttttttttttttttttttttttttt

SEQ ID NO: 5222 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncacgacaanntttttttttttttttttttttttttttttt

SEQ ID NO: 5223 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntacggaganntttttttttttttttttttttttttttttt

SEQ ID NO: 5224 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncgacaaganntttttttttttttttttttttttttttttt

SEQ ID NO: 5225 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncgaagtganntttttttttttttttttttttttttttttt

SEQ ID NO: 5226 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnagctggtanntttttttttttttttttttttttttttttt

SEQ ID NO: 5227 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnaactaggcnntttttttttttttttttttttttttttttt

SEQ ID NO: 5228 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncagcaagtnntttttttttttttttttttttttttttttt

SEQ ID NO: 5229 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnacgaggtanntttttttttttttttttttttttttttttt

SEQ ID NO: 5230 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncatcttccnntttttttttttttttttttttttttttttt

SEQ ID NO: 5231 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncctgaatcnntttttttttttttttttttttttttttttt

SEQ ID NO: 5232 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnntgcagactnntttttttttttttttttttttttttttttt

SEQ ID NO: 5233 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnagatgtggnntttttttttttttttttttttttttttttt

SEQ ID NO: 5234 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnagttcgacnntttttttttttttttttttttttttttttt

SEQ ID NO: 5235 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnnacaacctcnntttttttttttttttttttttttttttttt

SEQ ID NO: 5236 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncatggtagnntttttttttttttttttttttttttttttt

SEQ ID NO: 5237 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncgtatctcnntttttttttttttttttttttttttttttt

SEQ ID NO: 5238 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncctagttcnntttttttttttttttttttttttttttttt

SEQ ID NO: 5239 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaggaagcnncaagagtcnntttttttttttttttttttttttttttttt

SEQ ID NO: 5240 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnaatcggcanntttttttttttttttttttttttttttttt

SEQ ID NO: 5241 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntacggcatnntttttttttttttttttttttttttttttt

SEQ ID NO: 5242 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnttggatcgnntttttttttttttttttttttttttttttt

SEQ ID NO: 5243 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntggaacganntttttttttttttttttttttttttttttt

SEQ ID NO: 5244 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnggcaatcanntttttttttttttttttttttttttttttt

SEQ ID NO: 5245 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngaatccganntttttttttttttttttttttttttttttt

SEQ ID NO: 5246 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnttacggtgnntttttttttttttttttttttttttttttt

SEQ ID NO: 5247 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncatatcggnntttttttttttttttttttttttttttttt

SEQ ID NO: 5248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncttcggtanntttttttttttttttttttttttttttttt

SEQ ID NO: 5249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntcctaacgnntttttttttttttttttttttttttttttt

SEQ ID NO: 5250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngtaagccanntttttttttttttttttttttttttttttt

SEQ ID NO: 5251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntaaggtggnntttttttttttttttttttttttttttttt

SEQ ID NO: 5252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnggtaagctnntttttttttttttttttttttttttttttt

SEQ ID NO: 5253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntgtgtcganntttttttttttttttttttttttttttttt

SEQ ID NO: 5254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngagcatganntttttttttttttttttttttttttttttt

SEQ ID NO: 5255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntcgaagtcnntttttttttttttttttttttttttttttt

SEQ ID NO: 5256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnggtgaacanntttttttttttttttttttttttttttttt

SEQ ID NO: 5257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnacatgcacnntttttttttttttttttttttttttttttt

SEQ ID NO: 5258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnccaacagtnntttttttttttttttttttttttttttttt

SEQ ID NO: 5259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnagaacagcnntttttttttttttttttttttttttttttt

SEQ ID NO: 5260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngaacacgtnntttttttttttttttttttttttttttttt

SEQ ID NO: 5261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnggtcttcanntttttttttttttttttttttttttttttt

SEQ ID NO: 5262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnaggttcagnntttttttttttttttttttttttttttttt

SEQ ID NO: 5263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnctagagcanntttttttttttttttttttttttttttttt

SEQ ID NO: 5264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncttctagcnntttttttttttttttttttttttttttttt

SEQ ID NO: 5265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngagtaacgnntttttttttttttttttttttttttttttt

SEQ ID NO: 5266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnctaagaggnntttttttttttttttttttttttttttttt

SEQ ID NO: 5267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnacgtgtagnntttttttttttttttttttttttttttttt

SEQ ID NO: 5268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnactacaggnntttttttttttttttttttttttttttttt

SEQ ID NO: 5269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntacaggtcnntttttttttttttttttttttttttttttt

SEQ ID NO: 5270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnctcacatgnntttttttttttttttttttttttttttttt

SEQ ID NO: 5271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnactaggagnntttttttttttttttttttttttttttttt

SEQ ID NO: 5272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnccatagganntttttttttttttttttttttttttttttt

SEQ ID NO: 5273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnggagaatcnntttttttttttttttttttttttttttttt

SEQ ID NO: 5274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngccaagaanntttttttttttttttttttttttttttttt

SEQ ID NO: 5275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnaaggcaagnntttttttttttttttttttttttttttttt

SEQ ID NO: 5276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnaatgtcgcnntttttttttttttttttttttttttttttt

SEQ ID NO: 5277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnatggaaccnntttttttttttttttttttttttttttttt

SEQ ID NO: 5278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnagaggcatnntttttttttttttttttttttttttttttt

SEQ ID NO: 5279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntgcatagcnntttttttttttttttttttttttttttttt

SEQ ID NO: 5280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnctaacgganntttttttttttttttttttttttttttttt

SEQ ID NO: 5281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntatcgaggnntttttttttttttttttttttttttttttt

SEQ ID NO: 5282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncatagcctnntttttttttttttttttttttttttttttt

SEQ ID NO: 5283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnatcgagacnntttttttttttttttttttttttttttttt

SEQ ID NO: 5284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnggaagagtnntttttttttttttttttttttttttttttt

SEQ ID NO: 5285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnccaagtagnntttttttttttttttttttttttttttttt

SEQ ID NO: 5286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnctgaacagnntttttttttttttttttttttttttttttt

SEQ ID NO: 5287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngtaggttcnntttttttttttttttttttttttttttttt

SEQ ID NO: 5288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngtatggacnntttttttttttttttttttttttttttttt

SEQ ID NO: 5289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntcgcaacanntttttttttttttttttttttttttttttt

SEQ ID NO: 5290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnccgctaatnntttttttttttttttttttttttttttttt

SEQ ID NO: 5291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngattcgcanntttttttttttttttttttttttttttttt

SEQ ID NO: 5292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncgatggaanntttttttttttttttttttttttttttttt

SEQ ID NO: 5293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnagcaagganntttttttttttttttttttttttttttttt

SEQ ID NO: 5294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncgtagcaanntttttttttttttttttttttttttttttt

SEQ ID NO: 5295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntggcagtanntttttttttttttttttttttttttttttt

SEQ ID NO: 5296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncggtagttnntttttttttttttttttttttttttttttt

SEQ ID NO: 5297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntgacttcgnntttttttttttttttttttttttttttttt

SEQ ID NO: 5298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngagtgcaanntttttttttttttttttttttttttttttt

SEQ ID NO: 5299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnacggtaacnntttttttttttttttttttttttttttttt

SEQ ID NO: 5300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnaagtggtgnntttttttttttttttttttttttttttttt

SEQ ID NO: 5301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnggagacaanntttttttttttttttttttttttttttttt

SEQ ID NO: 5302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntcaaggacnntttttttttttttttttttttttttttttt

SEQ ID NO: 5303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnaagagagcnntttttttttttttttttttttttttttttt

SEQ ID NO: 5304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncgagagatnntttttttttttttttttttttttttttttt

SEQ ID NO: 5305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnacagatggnntttttttttttttttttttttttttttttt

SEQ ID NO: 5306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnaggagtcanntttttttttttttttttttttttttttttt

SEQ ID NO: 5307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncgtgttacnntttttttttttttttttttttttttttttt

SEQ ID NO: 5308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntagtgtgcnntttttttttttttttttttttttttttttt

SEQ ID NO: 5309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnctcatgacnntttttttttttttttttttttttttttttt

SEQ ID NO: 5310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngtatccagnntttttttttttttttttttttttttttttt

SEQ ID NO: 5311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnacgcctatnntttttttttttttttttttttttttttttt

SEQ ID NO: 5312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnaacgacctnntttttttttttttttttttttttttttttt

SEQ ID NO: 5313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnatcaggctnntttttttttttttttttttttttttttttt

SEQ ID NO: 5314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncaagttcgnntttttttttttttttttttttttttttttt

SEQ ID NO: 5315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntagccaganntttttttttttttttttttttttttttttt

SEQ ID NO: 5316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncaatcacgnntttttttttttttttttttttttttttttt

SEQ ID NO: 5317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnngcaacaagnntttttttttttttttttttttttttttttt

SEQ ID NO: 5318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncacgacaanntttttttttttttttttttttttttttttt

SEQ ID NO: 5319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntacggaganntttttttttttttttttttttttttttttt

SEQ ID NO: 5320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncgacaaganntttttttttttttttttttttttttttttt

SEQ ID NO: 5321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncgaagtganntttttttttttttttttttttttttttttt

SEQ ID NO: 5322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnagctggtanntttttttttttttttttttttttttttttt

SEQ ID NO: 5323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnaactaggcnntttttttttttttttttttttttttttttt

SEQ ID NO: 5324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncagcaagtnntttttttttttttttttttttttttttttt

SEQ ID NO: 5325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnacgaggtanntttttttttttttttttttttttttttttt

SEQ ID NO: 5326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncatcttccnntttttttttttttttttttttttttttttt

SEQ ID NO: 5327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncctgaatcnntttttttttttttttttttttttttttttt

SEQ ID NO: 5328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnntgcagactnntttttttttttttttttttttttttttttt

SEQ ID NO: 5329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnagatgtggnntttttttttttttttttttttttttttttt

SEQ ID NO: 5330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnagttcgacnntttttttttttttttttttttttttttttt

SEQ ID NO: 5331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnnacaacctcnntttttttttttttttttttttttttttttt

SEQ ID NO: 5332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncatggtagnntttttttttttttttttttttttttttttt

SEQ ID NO: 5333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncgtatctcnntttttttttttttttttttttttttttttt

SEQ ID NO: 5334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncctagttcnntttttttttttttttttttttttttttttt

SEQ ID NO: 5335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttcaggagnncaagagtcnntttttttttttttttttttttttttttttt

SEQ ID NO: 5336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnaatcggcanntttttttttttttttttttttttttttttt

SEQ ID NO: 5337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntacggcatnntttttttttttttttttttttttttttttt

SEQ ID NO: 5338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnttggatcgnntttttttttttttttttttttttttttttt

SEQ ID NO: 5339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntggaacganntttttttttttttttttttttttttttttt

SEQ ID NO: 5340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnggcaatcanntttttttttttttttttttttttttttttt

SEQ ID NO: 5341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngaatccganntttttttttttttttttttttttttttttt

SEQ ID NO: 5342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnttacggtgnntttttttttttttttttttttttttttttt

SEQ ID NO: 5343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncatatcggnntttttttttttttttttttttttttttttt

SEQ ID NO: 5344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncttcggtanntttttttttttttttttttttttttttttt

SEQ ID NO: 5345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntcctaacgnntttttttttttttttttttttttttttttt

SEQ ID NO: 5346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngtaagccanntttttttttttttttttttttttttttttt

SEQ ID NO: 5347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntaaggtggnntttttttttttttttttttttttttttttt

SEQ ID NO: 5348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnggtaagctnntttttttttttttttttttttttttttttt

SEQ ID NO: 5349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntgtgtcganntttttttttttttttttttttttttttttt

SEQ ID NO: 5350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngagcatganntttttttttttttttttttttttttttttt

SEQ ID NO: 5351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntcgaagtcnntttttttttttttttttttttttttttttt

SEQ ID NO: 5352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnggtgaacanntttttttttttttttttttttttttttttt

SEQ ID NO: 5353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnacatgcacnntttttttttttttttttttttttttttttt

SEQ ID NO: 5354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnccaacagtnntttttttttttttttttttttttttttttt

SEQ ID NO: 5355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnagaacagcnntttttttttttttttttttttttttttttt

SEQ ID NO: 5356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngaacacgtnntttttttttttttttttttttttttttttt

SEQ ID NO: 5357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnggtcttcanntttttttttttttttttttttttttttttt

SEQ ID NO: 5358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnaggttcagnntttttttttttttttttttttttttttttt

SEQ ID NO: 5359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnctagagcanntttttttttttttttttttttttttttttt

SEQ ID NO: 5360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncttctagcnntttttttttttttttttttttttttttttt

SEQ ID NO: 5361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngagtaacgnntttttttttttttttttttttttttttttt

SEQ ID NO: 5362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnctaagaggnntttttttttttttttttttttttttttttt

SEQ ID NO: 5363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnacgtgtagnntttttttttttttttttttttttttttttt

SEQ ID NO: 5364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnactacaggnntttttttttttttttttttttttttttttt

SEQ ID NO: 5365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntacaggtcnntttttttttttttttttttttttttttttt

SEQ ID NO: 5366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnctcacatgnntttttttttttttttttttttttttttttt

SEQ ID NO: 5367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnactaggagnntttttttttttttttttttttttttttttt

SEQ ID NO: 5368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnccatagganntttttttttttttttttttttttttttttt

SEQ ID NO: 5369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnggagaatcnntttttttttttttttttttttttttttttt

SEQ ID NO: 5370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngccaagaanntttttttttttttttttttttttttttttt

SEQ ID NO: 5371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnaaggcaagnntttttttttttttttttttttttttttttt

SEQ ID NO: 5372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnaatgtcgcnntttttttttttttttttttttttttttttt

SEQ ID NO: 5373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnatggaaccnntttttttttttttttttttttttttttttt

SEQ ID NO: 5374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnagaggcatnntttttttttttttttttttttttttttttt

SEQ ID NO: 5375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntgcatagcnntttttttttttttttttttttttttttttt

SEQ ID NO: 5376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnctaacgganntttttttttttttttttttttttttttttt

SEQ ID NO: 5377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntatcgaggnntttttttttttttttttttttttttttttt

SEQ ID NO: 5378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncatagcctnntttttttttttttttttttttttttttttt

SEQ ID NO: 5379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnatcgagacnntttttttttttttttttttttttttttttt

SEQ ID NO: 5380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnggaagagtnntttttttttttttttttttttttttttttt

SEQ ID NO: 5381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnccaagtagnntttttttttttttttttttttttttttttt

SEQ ID NO: 5382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnctgaacagnntttttttttttttttttttttttttttttt

SEQ ID NO: 5383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngtaggttcnntttttttttttttttttttttttttttttt

SEQ ID NO: 5384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngtatggacnntttttttttttttttttttttttttttttt

SEQ ID NO: 5385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntcgcaacanntttttttttttttttttttttttttttttt

SEQ ID NO: 5386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnccgctaatnntttttttttttttttttttttttttttttt

SEQ ID NO: 5387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngattcgcanntttttttttttttttttttttttttttttt

SEQ ID NO: 5388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncgatggaanntttttttttttttttttttttttttttttt

SEQ ID NO: 5389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnagcaagganntttttttttttttttttttttttttttttt

SEQ ID NO: 5390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncgtagcaanntttttttttttttttttttttttttttttt

SEQ ID NO: 5391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntggcagtanntttttttttttttttttttttttttttttt

SEQ ID NO: 5392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncggtagttnntttttttttttttttttttttttttttttt

SEQ ID NO: 5393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntgacttcgnntttttttttttttttttttttttttttttt

SEQ ID NO: 5394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngagtgcaanntttttttttttttttttttttttttttttt

SEQ ID NO: 5395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnacggtaacnntttttttttttttttttttttttttttttt

SEQ ID NO: 5396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnaagtggtgnntttttttttttttttttttttttttttttt

SEQ ID NO: 5397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnggagacaanntttttttttttttttttttttttttttttt

SEQ ID NO: 5398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntcaaggacnntttttttttttttttttttttttttttttt

SEQ ID NO: 5399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnaagagagcnntttttttttttttttttttttttttttttt

SEQ ID NO: 5400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncgagagatnntttttttttttttttttttttttttttttt

SEQ ID NO: 5401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnacagatggnntttttttttttttttttttttttttttttt

SEQ ID NO: 5402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnaggagtcanntttttttttttttttttttttttttttttt

SEQ ID NO: 5403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncgtgttacnntttttttttttttttttttttttttttttt

SEQ ID NO: 5404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntagtgtgcnntttttttttttttttttttttttttttttt

SEQ ID NO: 5405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnctcatgacnntttttttttttttttttttttttttttttt

SEQ ID NO: 5406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngtatccagnntttttttttttttttttttttttttttttt

SEQ ID NO: 5407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnacgcctatnntttttttttttttttttttttttttttttt

SEQ ID NO: 5408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnaacgacctnntttttttttttttttttttttttttttttt

SEQ ID NO: 5409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnatcaggctnntttttttttttttttttttttttttttttt

SEQ ID NO: 5410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncaagttcgnntttttttttttttttttttttttttttttt

SEQ ID NO: 5411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntagccaganntttttttttttttttttttttttttttttt

SEQ ID NO: 5412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncaatcacgnntttttttttttttttttttttttttttttt

SEQ ID NO: 5413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnngcaacaagnntttttttttttttttttttttttttttttt

SEQ ID NO: 5414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncacgacaanntttttttttttttttttttttttttttttt

SEQ ID NO: 5415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntacggaganntttttttttttttttttttttttttttttt

SEQ ID NO: 5416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncgacaaganntttttttttttttttttttttttttttttt

SEQ ID NO: 5417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncgaagtganntttttttttttttttttttttttttttttt

SEQ ID NO: 5418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnagctggtanntttttttttttttttttttttttttttttt

SEQ ID NO: 5419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnaactaggcnntttttttttttttttttttttttttttttt

SEQ ID NO: 5420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncagcaagtnntttttttttttttttttttttttttttttt

SEQ ID NO: 5421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnacgaggtanntttttttttttttttttttttttttttttt

SEQ ID NO: 5422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncatcttccnntttttttttttttttttttttttttttttt

SEQ ID NO: 5423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncctgaatcnntttttttttttttttttttttttttttttt

SEQ ID NO: 5424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnntgcagactnntttttttttttttttttttttttttttttt

SEQ ID NO: 5425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnagatgtggnntttttttttttttttttttttttttttttt

SEQ ID NO: 5426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnagttcgacnntttttttttttttttttttttttttttttt

SEQ ID NO: 5427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnnacaacctcnntttttttttttttttttttttttttttttt

SEQ ID NO: 5428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncatggtagnntttttttttttttttttttttttttttttt

SEQ ID NO: 5429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncgtatctcnntttttttttttttttttttttttttttttt

SEQ ID NO: 5430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncctagttcnntttttttttttttttttttttttttttttt

SEQ ID NO: 5431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtcataggnncaagagtcnntttttttttttttttttttttttttttttt

SEQ ID NO: 5432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannaatcggcanntttttttttttttttttttttttttttttt

SEQ ID NO: 5433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntacggcatnntttttttttttttttttttttttttttttt

SEQ ID NO: 5434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannttggatcgnntttttttttttttttttttttttttttttt

SEQ ID NO: 5435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntggaacganntttttttttttttttttttttttttttttt

SEQ ID NO: 5436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannggcaatcanntttttttttttttttttttttttttttttt

SEQ ID NO: 5437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngaatccganntttttttttttttttttttttttttttttt

SEQ ID NO: 5438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannttacggtgnntttttttttttttttttttttttttttttt

SEQ ID NO: 5439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncatatcggnntttttttttttttttttttttttttttttt

SEQ ID NO: 5440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncttcggtanntttttttttttttttttttttttttttttt

SEQ ID NO: 5441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntcctaacgnntttttttttttttttttttttttttttttt

SEQ ID NO: 5442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngtaagccanntttttttttttttttttttttttttttttt

SEQ ID NO: 5443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntaaggtggnntttttttttttttttttttttttttttttt

SEQ ID NO: 5444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannggtaagctnntttttttttttttttttttttttttttttt

SEQ ID NO: 5445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntgtgtcganntttttttttttttttttttttttttttttt

SEQ ID NO: 5446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngagcatganntttttttttttttttttttttttttttttt

SEQ ID NO: 5447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntcgaagtcnntttttttttttttttttttttttttttttt

SEQ ID NO: 5448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannggtgaacanntttttttttttttttttttttttttttttt

SEQ ID NO: 5449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannacatgcacnntttttttttttttttttttttttttttttt

SEQ ID NO: 5450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannccaacagtnntttttttttttttttttttttttttttttt

SEQ ID NO: 5451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannagaacagcnntttttttttttttttttttttttttttttt

SEQ ID NO: 5452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngaacacgtnntttttttttttttttttttttttttttttt

SEQ ID NO: 5453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannggtcttcanntttttttttttttttttttttttttttttt

SEQ ID NO: 5454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannaggttcagnntttttttttttttttttttttttttttttt

SEQ ID NO: 5455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannctagagcanntttttttttttttttttttttttttttttt

SEQ ID NO: 5456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncttctagcnntttttttttttttttttttttttttttttt

SEQ ID NO: 5457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngagtaacgnntttttttttttttttttttttttttttttt

SEQ ID NO: 5458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannctaagaggnntttttttttttttttttttttttttttttt

SEQ ID NO: 5459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannacgtgtagnntttttttttttttttttttttttttttttt

SEQ ID NO: 5460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannactacaggnntttttttttttttttttttttttttttttt

SEQ ID NO: 5461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntacaggtcnntttttttttttttttttttttttttttttt

SEQ ID NO: 5462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannctcacatgnntttttttttttttttttttttttttttttt

SEQ ID NO: 5463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannactaggagnntttttttttttttttttttttttttttttt

SEQ ID NO: 5464 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannccatagganntttttttttttttttttttttttttttttt

SEQ ID NO: 5465 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannggagaatcnntttttttttttttttttttttttttttttt

SEQ ID NO: 5466 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngccaagaanntttttttttttttttttttttttttttttt

SEQ ID NO: 5467 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannaaggcaagnntttttttttttttttttttttttttttttt

SEQ ID NO: 5468 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannaatgtcgcnntttttttttttttttttttttttttttttt

SEQ ID NO: 5469 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannatggaaccnntttttttttttttttttttttttttttttt

SEQ ID NO: 5470 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannagaggcatnntttttttttttttttttttttttttttttt

SEQ ID NO: 5471 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntgcatagcnntttttttttttttttttttttttttttttt

SEQ ID NO: 5472 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannctaacgganntttttttttttttttttttttttttttttt

SEQ ID NO: 5473 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntatcgaggnntttttttttttttttttttttttttttttt

SEQ ID NO: 5474 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncatagcctnntttttttttttttttttttttttttttttt

SEQ ID NO: 5475 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannatcgagacnntttttttttttttttttttttttttttttt

SEQ ID NO: 5476 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannggaagagtnntttttttttttttttttttttttttttttt

SEQ ID NO: 5477 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannccaagtagnntttttttttttttttttttttttttttttt

SEQ ID NO: 5478 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannctgaacagnntttttttttttttttttttttttttttttt

SEQ ID NO: 5479 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngtaggttcnntttttttttttttttttttttttttttttt

SEQ ID NO: 5480 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngtatggacnntttttttttttttttttttttttttttttt

SEQ ID NO: 5481 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntcgcaacanntttttttttttttttttttttttttttttt

SEQ ID NO: 5482 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannccgctaatnntttttttttttttttttttttttttttttt

SEQ ID NO: 5483 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngattcgcanntttttttttttttttttttttttttttttt

SEQ ID NO: 5484 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncgatggaanntttttttttttttttttttttttttttttt

SEQ ID NO: 5485 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannagcaagganntttttttttttttttttttttttttttttt

SEQ ID NO: 5486 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncgtagcaanntttttttttttttttttttttttttttttt

SEQ ID NO: 5487 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntggcagtanntttttttttttttttttttttttttttttt

SEQ ID NO: 5488 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncggtagttnntttttttttttttttttttttttttttttt

SEQ ID NO: 5489 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntgacttcgnntttttttttttttttttttttttttttttt

SEQ ID NO: 5490 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngagtgcaanntttttttttttttttttttttttttttttt

SEQ ID NO: 5491 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannacggtaacnntttttttttttttttttttttttttttttt

SEQ ID NO: 5492 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannaagtggtgnntttttttttttttttttttttttttttttt

SEQ ID NO: 5493 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannggagacaanntttttttttttttttttttttttttttttt

SEQ ID NO: 5494 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntcaaggacnntttttttttttttttttttttttttttttt

SEQ ID NO: 5495 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannaagagagcnntttttttttttttttttttttttttttttt

SEQ ID NO: 5496 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncgagagatnntttttttttttttttttttttttttttttt

SEQ ID NO: 5497 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannacagatggnntttttttttttttttttttttttttttttt

SEQ ID NO: 5498 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannaggagtcanntttttttttttttttttttttttttttttt

SEQ ID NO: 5499 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncgtgttacnntttttttttttttttttttttttttttttt

SEQ ID NO: 5500 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntagtgtgcnntttttttttttttttttttttttttttttt

SEQ ID NO: 5501 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannctcatgacnntttttttttttttttttttttttttttttt

SEQ ID NO: 5502 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngtatccagnntttttttttttttttttttttttttttttt

SEQ ID NO: 5503 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannacgcctatnntttttttttttttttttttttttttttttt

SEQ ID NO: 5504 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannaacgacctnntttttttttttttttttttttttttttttt

SEQ ID NO: 5505 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannatcaggctnntttttttttttttttttttttttttttttt

SEQ ID NO: 5506 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncaagttcgnntttttttttttttttttttttttttttttt

SEQ ID NO: 5507 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntagccaganntttttttttttttttttttttttttttttt

SEQ ID NO: 5508 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncaatcacgnntttttttttttttttttttttttttttttt

SEQ ID NO: 5509 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanngcaacaagnntttttttttttttttttttttttttttttt

SEQ ID NO: 5510 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncacgacaanntttttttttttttttttttttttttttttt

SEQ ID NO: 5511 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntacggaganntttttttttttttttttttttttttttttt

SEQ ID NO: 5512 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncgacaaganntttttttttttttttttttttttttttttt

SEQ ID NO: 5513 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncgaagtganntttttttttttttttttttttttttttttt

SEQ ID NO: 5514 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannagctggtanntttttttttttttttttttttttttttttt

SEQ ID NO: 5515 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannaactaggcnntttttttttttttttttttttttttttttt

SEQ ID NO: 5516 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncagcaagtnntttttttttttttttttttttttttttttt

SEQ ID NO: 5517 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannacgaggtanntttttttttttttttttttttttttttttt

SEQ ID NO: 5518 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncatcttccnntttttttttttttttttttttttttttttt

SEQ ID NO: 5519 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncctgaatcnntttttttttttttttttttttttttttttt

SEQ ID NO: 5520 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanntgcagactnntttttttttttttttttttttttttttttt

SEQ ID NO: 5521 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannagatgtggnntttttttttttttttttttttttttttttt

SEQ ID NO: 5522 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannagttcgacnntttttttttttttttttttttttttttttt

SEQ ID NO: 5523 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaannacaacctcnntttttttttttttttttttttttttttttt

SEQ ID NO: 5524 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncatggtagnntttttttttttttttttttttttttttttt

SEQ ID NO: 5525 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncgtatctcnntttttttttttttttttttttttttttttt

SEQ ID NO: 5526 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncctagttcnntttttttttttttttttttttttttttttt

SEQ ID NO: 5527 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaacggaanncaagagtcnntttttttttttttttttttttttttttttt

SEQ ID NO: 5528 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnaatcggcanntttttttttttttttttttttttttttttt

SEQ ID NO: 5529 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntacggcatnntttttttttttttttttttttttttttttt

SEQ ID NO: 5530 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnttggatcgnntttttttttttttttttttttttttttttt

SEQ ID NO: 5531 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntggaacganntttttttttttttttttttttttttttttt

SEQ ID NO: 5532 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnggcaatcanntttttttttttttttttttttttttttttt

SEQ ID NO: 5533 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngaatccganntttttttttttttttttttttttttttttt

SEQ ID NO: 5534 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnttacggtgnntttttttttttttttttttttttttttttt

SEQ ID NO: 5535 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncatatcggnntttttttttttttttttttttttttttttt

SEQ ID NO: 5536 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncttcggtanntttttttttttttttttttttttttttttt

SEQ ID NO: 5537 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntcctaacgnntttttttttttttttttttttttttttttt

SEQ ID NO: 5538 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngtaagccanntttttttttttttttttttttttttttttt

SEQ ID NO: 5539 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntaaggtggnntttttttttttttttttttttttttttttt

SEQ ID NO: 5540 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnggtaagctnntttttttttttttttttttttttttttttt

SEQ ID NO: 5541 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntgtgtcganntttttttttttttttttttttttttttttt

SEQ ID NO: 5542 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngagcatganntttttttttttttttttttttttttttttt

SEQ ID NO: 5543 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntcgaagtcnntttttttttttttttttttttttttttttt

SEQ ID NO: 5544 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnggtgaacanntttttttttttttttttttttttttttttt

SEQ ID NO: 5545 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnacatgcacnntttttttttttttttttttttttttttttt

SEQ ID NO: 5546 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnccaacagtnntttttttttttttttttttttttttttttt

SEQ ID NO: 5547 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnagaacagcnntttttttttttttttttttttttttttttt

SEQ ID NO: 5548 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngaacacgtnntttttttttttttttttttttttttttttt

SEQ ID NO: 5549 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnggtcttcanntttttttttttttttttttttttttttttt

SEQ ID NO: 5550 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnaggttcagnntttttttttttttttttttttttttttttt

SEQ ID NO: 5551 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnctagagcanntttttttttttttttttttttttttttttt

SEQ ID NO: 5552 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncttctagcnntttttttttttttttttttttttttttttt

SEQ ID NO: 5553 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngagtaacgnntttttttttttttttttttttttttttttt

SEQ ID NO: 5554 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnctaagaggnntttttttttttttttttttttttttttttt

SEQ ID NO: 5555 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnacgtgtagnntttttttttttttttttttttttttttttt

SEQ ID NO: 5556 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnactacaggnntttttttttttttttttttttttttttttt

SEQ ID NO: 5557 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntacaggtcnntttttttttttttttttttttttttttttt

SEQ ID NO: 5558 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnctcacatgnntttttttttttttttttttttttttttttt

SEQ ID NO: 5559 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnactaggagnntttttttttttttttttttttttttttttt

SEQ ID NO: 5560 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnccatagganntttttttttttttttttttttttttttttt

SEQ ID NO: 5561 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnggagaatcnntttttttttttttttttttttttttttttt

SEQ ID NO: 5562 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngccaagaanntttttttttttttttttttttttttttttt

SEQ ID NO: 5563 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnaaggcaagnntttttttttttttttttttttttttttttt

SEQ ID NO: 5564 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnaatgtcgcnntttttttttttttttttttttttttttttt

SEQ ID NO: 5565 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnatggaaccnntttttttttttttttttttttttttttttt

SEQ ID NO: 5566 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnagaggcatnntttttttttttttttttttttttttttttt

SEQ ID NO: 5567 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntgcatagcnntttttttttttttttttttttttttttttt

SEQ ID NO: 5568 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnctaacgganntttttttttttttttttttttttttttttt

SEQ ID NO: 5569 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntatcgaggnntttttttttttttttttttttttttttttt

SEQ ID NO: 5570 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncatagcctnntttttttttttttttttttttttttttttt

SEQ ID NO: 5571 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnatcgagacnntttttttttttttttttttttttttttttt

SEQ ID NO: 5572 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnggaagagtnntttttttttttttttttttttttttttttt

SEQ ID NO: 5573 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnccaagtagnntttttttttttttttttttttttttttttt

SEQ ID NO: 5574 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnctgaacagnntttttttttttttttttttttttttttttt

SEQ ID NO: 5575 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngtaggttcnntttttttttttttttttttttttttttttt

SEQ ID NO: 5576 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngtatggacnntttttttttttttttttttttttttttttt

SEQ ID NO: 5577 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntcgcaacanntttttttttttttttttttttttttttttt

SEQ ID NO: 5578 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnccgctaatnntttttttttttttttttttttttttttttt

SEQ ID NO: 5579 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngattcgcanntttttttttttttttttttttttttttttt

SEQ ID NO: 5580 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncgatggaanntttttttttttttttttttttttttttttt

SEQ ID NO: 5581 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnagcaagganntttttttttttttttttttttttttttttt

SEQ ID NO: 5582 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncgtagcaanntttttttttttttttttttttttttttttt

SEQ ID NO: 5583 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntggcagtanntttttttttttttttttttttttttttttt

SEQ ID NO: 5584 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncggtagttnntttttttttttttttttttttttttttttt

SEQ ID NO: 5585 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntgacttcgnntttttttttttttttttttttttttttttt

SEQ ID NO: 5586 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngagtgcaanntttttttttttttttttttttttttttttt

SEQ ID NO: 5587 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnacggtaacnntttttttttttttttttttttttttttttt

SEQ ID NO: 5588 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnaagtggtgnntttttttttttttttttttttttttttttt

SEQ ID NO: 5589 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnggagacaanntttttttttttttttttttttttttttttt

SEQ ID NO: 5590 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntcaaggacnntttttttttttttttttttttttttttttt

SEQ ID NO: 5591 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnaagagagcnntttttttttttttttttttttttttttttt

SEQ ID NO: 5592 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncgagagatnntttttttttttttttttttttttttttttt

SEQ ID NO: 5593 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnacagatggnntttttttttttttttttttttttttttttt

SEQ ID NO: 5594 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnaggagtcanntttttttttttttttttttttttttttttt

SEQ ID NO: 5595 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncgtgttacnntttttttttttttttttttttttttttttt

SEQ ID NO: 5596 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntagtgtgcnntttttttttttttttttttttttttttttt

SEQ ID NO: 5597 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnctcatgacnntttttttttttttttttttttttttttttt

SEQ ID NO: 5598 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngtatccagnntttttttttttttttttttttttttttttt

SEQ ID NO: 5599 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnacgcctatnntttttttttttttttttttttttttttttt

SEQ ID NO: 5600 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnaacgacctnntttttttttttttttttttttttttttttt

SEQ ID NO: 5601 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnatcaggctnntttttttttttttttttttttttttttttt

SEQ ID NO: 5602 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncaagttcgnntttttttttttttttttttttttttttttt

SEQ ID NO: 5603 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntagccaganntttttttttttttttttttttttttttttt

SEQ ID NO: 5604 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncaatcacgnntttttttttttttttttttttttttttttt

SEQ ID NO: 5605 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnngcaacaagnntttttttttttttttttttttttttttttt

SEQ ID NO: 5606 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncacgacaanntttttttttttttttttttttttttttttt

SEQ ID NO: 5607 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntacggaganntttttttttttttttttttttttttttttt

SEQ ID NO: 5608 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncgacaaganntttttttttttttttttttttttttttttt

SEQ ID NO: 5609 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncgaagtganntttttttttttttttttttttttttttttt

SEQ ID NO: 5610 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnagctggtanntttttttttttttttttttttttttttttt

SEQ ID NO: 5611 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnaactaggcnntttttttttttttttttttttttttttttt

SEQ ID NO: 5612 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncagcaagtnntttttttttttttttttttttttttttttt

SEQ ID NO: 5613 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnacgaggtanntttttttttttttttttttttttttttttt

SEQ ID NO: 5614 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncatcttccnntttttttttttttttttttttttttttttt

SEQ ID NO: 5615 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncctgaatcnntttttttttttttttttttttttttttttt

SEQ ID NO: 5616 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnntgcagactnntttttttttttttttttttttttttttttt

SEQ ID NO: 5617 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnagatgtggnntttttttttttttttttttttttttttttt

SEQ ID NO: 5618 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnagttcgacnntttttttttttttttttttttttttttttt

SEQ ID NO: 5619 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnnacaacctcnntttttttttttttttttttttttttttttt

SEQ ID NO: 5620 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncatggtagnntttttttttttttttttttttttttttttt

SEQ ID NO: 5621 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncgtatctcnntttttttttttttttttttttttttttttt

SEQ ID NO: 5622 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncctagttcnntttttttttttttttttttttttttttttt

SEQ ID NO: 5623 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaatggacgnncaagagtcnntttttttttttttttttttttttttttttt

SEQ ID NO: 5624 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnaatcggcanntttttttttttttttttttttttttttttt

SEQ ID NO: 5625 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntacggcatnntttttttttttttttttttttttttttttt

SEQ ID NO: 5626 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnttggatcgnntttttttttttttttttttttttttttttt

SEQ ID NO: 5627 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntggaacganntttttttttttttttttttttttttttttt

SEQ ID NO: 5628 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnggcaatcanntttttttttttttttttttttttttttttt

SEQ ID NO: 5629 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngaatccganntttttttttttttttttttttttttttttt

SEQ ID NO: 5630 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnttacggtgnntttttttttttttttttttttttttttttt

SEQ ID NO: 5631 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncatatcggnntttttttttttttttttttttttttttttt

SEQ ID NO: 5632 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncttcggtanntttttttttttttttttttttttttttttt

SEQ ID NO: 5633 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntcctaacgnntttttttttttttttttttttttttttttt

SEQ ID NO: 5634 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngtaagccanntttttttttttttttttttttttttttttt

SEQ ID NO: 5635 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntaaggtggnntttttttttttttttttttttttttttttt

SEQ ID NO: 5636 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnggtaagctnntttttttttttttttttttttttttttttt

SEQ ID NO: 5637 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntgtgtcganntttttttttttttttttttttttttttttt

SEQ ID NO: 5638 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngagcatganntttttttttttttttttttttttttttttt

SEQ ID NO: 5639 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntcgaagtcnntttttttttttttttttttttttttttttt

SEQ ID NO: 5640 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnggtgaacanntttttttttttttttttttttttttttttt

SEQ ID NO: 5641 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnacatgcacnntttttttttttttttttttttttttttttt

SEQ ID NO: 5642 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnccaacagtnntttttttttttttttttttttttttttttt

SEQ ID NO: 5643 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnagaacagcnntttttttttttttttttttttttttttttt

SEQ ID NO: 5644 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngaacacgtnntttttttttttttttttttttttttttttt

SEQ ID NO: 5645 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnggtcttcanntttttttttttttttttttttttttttttt

SEQ ID NO: 5646 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnaggttcagnntttttttttttttttttttttttttttttt

SEQ ID NO: 5647 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnctagagcanntttttttttttttttttttttttttttttt

SEQ ID NO: 5648 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncttctagcnntttttttttttttttttttttttttttttt

SEQ ID NO: 5649 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngagtaacgnntttttttttttttttttttttttttttttt

SEQ ID NO: 5650 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnctaagaggnntttttttttttttttttttttttttttttt

SEQ ID NO: 5651 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnacgtgtagnntttttttttttttttttttttttttttttt

SEQ ID NO: 5652 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnactacaggnntttttttttttttttttttttttttttttt

SEQ ID NO: 5653 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntacaggtcnntttttttttttttttttttttttttttttt

SEQ ID NO: 5654 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnctcacatgnntttttttttttttttttttttttttttttt

SEQ ID NO: 5655 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnactaggagnntttttttttttttttttttttttttttttt

SEQ ID NO: 5656 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnccatagganntttttttttttttttttttttttttttttt

SEQ ID NO: 5657 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnggagaatcnntttttttttttttttttttttttttttttt

SEQ ID NO: 5658 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngccaagaanntttttttttttttttttttttttttttttt

SEQ ID NO: 5659 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnaaggcaagnntttttttttttttttttttttttttttttt

SEQ ID NO: 5660 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnaatgtcgcnntttttttttttttttttttttttttttttt

SEQ ID NO: 5661 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnatggaaccnntttttttttttttttttttttttttttttt

SEQ ID NO: 5662 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnagaggcatnntttttttttttttttttttttttttttttt

SEQ ID NO: 5663 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntgcatagcnntttttttttttttttttttttttttttttt

SEQ ID NO: 5664 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnctaacgganntttttttttttttttttttttttttttttt

SEQ ID NO: 5665 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntatcgaggnntttttttttttttttttttttttttttttt

SEQ ID NO: 5666 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncatagcctnntttttttttttttttttttttttttttttt

SEQ ID NO: 5667 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnatcgagacnntttttttttttttttttttttttttttttt

SEQ ID NO: 5668 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnggaagagtnntttttttttttttttttttttttttttttt

SEQ ID NO: 5669 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnccaagtagnntttttttttttttttttttttttttttttt

SEQ ID NO: 5670 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnctgaacagnntttttttttttttttttttttttttttttt

SEQ ID NO: 5671 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngtaggttcnntttttttttttttttttttttttttttttt

SEQ ID NO: 5672 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngtatggacnntttttttttttttttttttttttttttttt

SEQ ID NO: 5673 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntcgcaacanntttttttttttttttttttttttttttttt

SEQ ID NO: 5674 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnccgctaatnntttttttttttttttttttttttttttttt

SEQ ID NO: 5675 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngattcgcanntttttttttttttttttttttttttttttt

SEQ ID NO: 5676 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncgatggaanntttttttttttttttttttttttttttttt

SEQ ID NO: 5677 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnagcaagganntttttttttttttttttttttttttttttt

SEQ ID NO: 5678 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncgtagcaanntttttttttttttttttttttttttttttt

SEQ ID NO: 5679 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntggcagtanntttttttttttttttttttttttttttttt

SEQ ID NO: 5680 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncggtagttnntttttttttttttttttttttttttttttt

SEQ ID NO: 5681 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntgacttcgnntttttttttttttttttttttttttttttt

SEQ ID NO: 5682 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngagtgcaanntttttttttttttttttttttttttttttt

SEQ ID NO: 5683 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnacggtaacnntttttttttttttttttttttttttttttt

SEQ ID NO: 5684 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnaagtggtgnntttttttttttttttttttttttttttttt

SEQ ID NO: 5685 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnggagacaanntttttttttttttttttttttttttttttt

SEQ ID NO: 5686 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntcaaggacnntttttttttttttttttttttttttttttt

SEQ ID NO: 5687 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnaagagagcnntttttttttttttttttttttttttttttt

SEQ ID NO: 5688 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncgagagatnntttttttttttttttttttttttttttttt

SEQ ID NO: 5689 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnacagatggnntttttttttttttttttttttttttttttt

SEQ ID NO: 5690 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnaggagtcanntttttttttttttttttttttttttttttt

SEQ ID NO: 5691 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncgtgttacnntttttttttttttttttttttttttttttt

SEQ ID NO: 5692 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntagtgtgcnntttttttttttttttttttttttttttttt

SEQ ID NO: 5693 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnctcatgacnntttttttttttttttttttttttttttttt

SEQ ID NO: 5694 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngtatccagnntttttttttttttttttttttttttttttt

SEQ ID NO: 5695 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnacgcctatnntttttttttttttttttttttttttttttt

SEQ ID NO: 5696 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnaacgacctnntttttttttttttttttttttttttttttt

SEQ ID NO: 5697 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnatcaggctnntttttttttttttttttttttttttttttt

SEQ ID NO: 5698 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncaagttcgnntttttttttttttttttttttttttttttt

SEQ ID NO: 5699 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntagccaganntttttttttttttttttttttttttttttt

SEQ ID NO: 5700 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncaatcacgnntttttttttttttttttttttttttttttt

SEQ ID NO: 5701 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnngcaacaagnntttttttttttttttttttttttttttttt

SEQ ID NO: 5702 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncacgacaanntttttttttttttttttttttttttttttt

SEQ ID NO: 5703 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntacggaganntttttttttttttttttttttttttttttt

SEQ ID NO: 5704 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncgacaaganntttttttttttttttttttttttttttttt

SEQ ID NO: 5705 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncgaagtganntttttttttttttttttttttttttttttt

SEQ ID NO: 5706 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnagctggtanntttttttttttttttttttttttttttttt

SEQ ID NO: 5707 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnaactaggcnntttttttttttttttttttttttttttttt

SEQ ID NO: 5708 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncagcaagtnntttttttttttttttttttttttttttttt

SEQ ID NO: 5709 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnacgaggtanntttttttttttttttttttttttttttttt

SEQ ID NO: 5710 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncatcttccnntttttttttttttttttttttttttttttt

SEQ ID NO: 5711 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncctgaatcnntttttttttttttttttttttttttttttt

SEQ ID NO: 5712 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnntgcagactnntttttttttttttttttttttttttttttt

SEQ ID NO: 5713 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnagatgtggnntttttttttttttttttttttttttttttt

SEQ ID NO: 5714 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnagttcgacnntttttttttttttttttttttttttttttt

SEQ ID NO: 5715 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnnacaacctcnntttttttttttttttttttttttttttttt

SEQ ID NO: 5716 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncatggtagnntttttttttttttttttttttttttttttt

SEQ ID NO: 5717 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncgtatctcnntttttttttttttttttttttttttttttt

SEQ ID NO: 5718 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncctagttcnntttttttttttttttttttttttttttttt

SEQ ID NO: 5719 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnatcggaagnncaagagtcnntttttttttttttttttttttttttttttt

SEQ ID NO: 5720 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannaatcggcanntttttttttttttttttttttttttttttt

SEQ ID NO: 5721 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntacggcatnntttttttttttttttttttttttttttttt

SEQ ID NO: 5722 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannttggatcgnntttttttttttttttttttttttttttttt

SEQ ID NO: 5723 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntggaacganntttttttttttttttttttttttttttttt

SEQ ID NO: 5724 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannggcaatcanntttttttttttttttttttttttttttttt

SEQ ID NO: 5725 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngaatccganntttttttttttttttttttttttttttttt

SEQ ID NO: 5726 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannttacggtgnntttttttttttttttttttttttttttttt

SEQ ID NO: 5727 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncatatcggnntttttttttttttttttttttttttttttt

SEQ ID NO: 5728 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncttcggtanntttttttttttttttttttttttttttttt

SEQ ID NO: 5729 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntcctaacgnntttttttttttttttttttttttttttttt

SEQ ID NO: 5730 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngtaagccanntttttttttttttttttttttttttttttt

SEQ ID NO: 5731 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntaaggtggnntttttttttttttttttttttttttttttt

SEQ ID NO: 5732 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannggtaagctnntttttttttttttttttttttttttttttt

SEQ ID NO: 5733 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntgtgtcganntttttttttttttttttttttttttttttt

SEQ ID NO: 5734 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngagcatganntttttttttttttttttttttttttttttt

SEQ ID NO: 5735 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntcgaagtcnntttttttttttttttttttttttttttttt

SEQ ID NO: 5736 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannggtgaacanntttttttttttttttttttttttttttttt

SEQ ID NO: 5737 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannacatgcacnntttttttttttttttttttttttttttttt

SEQ ID NO: 5738 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannccaacagtnntttttttttttttttttttttttttttttt

SEQ ID NO: 5739 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannagaacagcnntttttttttttttttttttttttttttttt

SEQ ID NO: 5740 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngaacacgtnntttttttttttttttttttttttttttttt

SEQ ID NO: 5741 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannggtcttcanntttttttttttttttttttttttttttttt

SEQ ID NO: 5742 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannaggttcagnntttttttttttttttttttttttttttttt

SEQ ID NO: 5743 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannctagagcanntttttttttttttttttttttttttttttt

SEQ ID NO: 5744 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncttctagcnntttttttttttttttttttttttttttttt

SEQ ID NO: 5745 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngagtaacgnntttttttttttttttttttttttttttttt

SEQ ID NO: 5746 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannctaagaggnntttttttttttttttttttttttttttttt

SEQ ID NO: 5747 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannacgtgtagnntttttttttttttttttttttttttttttt

SEQ ID NO: 5748 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannactacaggnntttttttttttttttttttttttttttttt

SEQ ID NO: 5749 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntacaggtcnntttttttttttttttttttttttttttttt

SEQ ID NO: 5750 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannctcacatgnntttttttttttttttttttttttttttttt

SEQ ID NO: 5751 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannactaggagnntttttttttttttttttttttttttttttt

SEQ ID NO: 5752 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannccatagganntttttttttttttttttttttttttttttt

SEQ ID NO: 5753 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannggagaatcnntttttttttttttttttttttttttttttt

SEQ ID NO: 5754 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngccaagaanntttttttttttttttttttttttttttttt

SEQ ID NO: 5755 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannaaggcaagnntttttttttttttttttttttttttttttt

SEQ ID NO: 5756 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannaatgtcgcnntttttttttttttttttttttttttttttt

SEQ ID NO: 5757 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannatggaaccnntttttttttttttttttttttttttttttt

SEQ ID NO: 5758 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannagaggcatnntttttttttttttttttttttttttttttt

SEQ ID NO: 5759 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntgcatagcnntttttttttttttttttttttttttttttt

SEQ ID NO: 5760 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannctaacgganntttttttttttttttttttttttttttttt

SEQ ID NO: 5761 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntatcgaggnntttttttttttttttttttttttttttttt

SEQ ID NO: 5762 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncatagcctnntttttttttttttttttttttttttttttt

SEQ ID NO: 5763 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannatcgagacnntttttttttttttttttttttttttttttt

SEQ ID NO: 5764 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannggaagagtnntttttttttttttttttttttttttttttt

SEQ ID NO: 5765 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannccaagtagnntttttttttttttttttttttttttttttt

SEQ ID NO: 5766 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannctgaacagnntttttttttttttttttttttttttttttt

SEQ ID NO: 5767 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngtaggttcnntttttttttttttttttttttttttttttt

SEQ ID NO: 5768 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngtatggacnntttttttttttttttttttttttttttttt

SEQ ID NO: 5769 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntcgcaacanntttttttttttttttttttttttttttttt

SEQ ID NO: 5770 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannccgctaatnntttttttttttttttttttttttttttttt

SEQ ID NO: 5771 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngattcgcanntttttttttttttttttttttttttttttt

SEQ ID NO: 5772 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncgatggaanntttttttttttttttttttttttttttttt

SEQ ID NO: 5773 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannagcaagganntttttttttttttttttttttttttttttt

SEQ ID NO: 5774 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncgtagcaanntttttttttttttttttttttttttttttt

SEQ ID NO: 5775 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntggcagtanntttttttttttttttttttttttttttttt

SEQ ID NO: 5776 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncggtagttnntttttttttttttttttttttttttttttt

SEQ ID NO: 5777 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntgacttcgnntttttttttttttttttttttttttttttt

SEQ ID NO: 5778 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngagtgcaanntttttttttttttttttttttttttttttt

SEQ ID NO: 5779 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannacggtaacnntttttttttttttttttttttttttttttt

SEQ ID NO: 5780 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannaagtggtgnntttttttttttttttttttttttttttttt

SEQ ID NO: 5781 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannggagacaanntttttttttttttttttttttttttttttt

SEQ ID NO: 5782 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntcaaggacnntttttttttttttttttttttttttttttt

SEQ ID NO: 5783 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannaagagagcnntttttttttttttttttttttttttttttt

SEQ ID NO: 5784 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncgagagatnntttttttttttttttttttttttttttttt

SEQ ID NO: 5785 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannacagatggnntttttttttttttttttttttttttttttt

SEQ ID NO: 5786 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannaggagtcanntttttttttttttttttttttttttttttt

SEQ ID NO: 5787 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncgtgttacnntttttttttttttttttttttttttttttt

SEQ ID NO: 5788 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntagtgtgcnntttttttttttttttttttttttttttttt

SEQ ID NO: 5789 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannctcatgacnntttttttttttttttttttttttttttttt

SEQ ID NO: 5790 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngtatccagnntttttttttttttttttttttttttttttt

SEQ ID NO: 5791 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannacgcctatnntttttttttttttttttttttttttttttt

SEQ ID NO: 5792 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannaacgacctnntttttttttttttttttttttttttttttt

SEQ ID NO: 5793 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannatcaggctnntttttttttttttttttttttttttttttt

SEQ ID NO: 5794 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncaagttcgnntttttttttttttttttttttttttttttt

SEQ ID NO: 5795 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntagccaganntttttttttttttttttttttttttttttt

SEQ ID NO: 5796 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncaatcacgnntttttttttttttttttttttttttttttt

SEQ ID NO: 5797 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganngcaacaagnntttttttttttttttttttttttttttttt

SEQ ID NO: 5798 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncacgacaanntttttttttttttttttttttttttttttt

SEQ ID NO: 5799 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntacggaganntttttttttttttttttttttttttttttt

SEQ ID NO: 5800 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncgacaaganntttttttttttttttttttttttttttttt

SEQ ID NO: 5801 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncgaagtganntttttttttttttttttttttttttttttt

SEQ ID NO: 5802 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannagctggtanntttttttttttttttttttttttttttttt

SEQ ID NO: 5803 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannaactaggcnntttttttttttttttttttttttttttttt

SEQ ID NO: 5804 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncagcaagtnntttttttttttttttttttttttttttttt

SEQ ID NO: 5805 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannacgaggtanntttttttttttttttttttttttttttttt

SEQ ID NO: 5806 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncatcttccnntttttttttttttttttttttttttttttt

SEQ ID NO: 5807 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncctgaatcnntttttttttttttttttttttttttttttt

SEQ ID NO: 5808 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganntgcagactnntttttttttttttttttttttttttttttt

SEQ ID NO: 5809 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannagatgtggnntttttttttttttttttttttttttttttt

SEQ ID NO: 5810 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannagttcgacnntttttttttttttttttttttttttttttt

SEQ ID NO: 5811 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacggannacaacctcnntttttttttttttttttttttttttttttt

SEQ ID NO: 5812 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncatggtagnntttttttttttttttttttttttttttttt

SEQ ID NO: 5813 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncgtatctcnntttttttttttttttttttttttttttttt

SEQ ID NO: 5814 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncctagttcnntttttttttttttttttttttttttttttt

SEQ ID NO: 5815 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnaagacgganncaagagtcnntttttttttttttttttttttttttttttt

SEQ ID NO: 5816 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnaatcggcanntttttttttttttttttttttttttttttt

SEQ ID NO: 5817 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntacggcatnntttttttttttttttttttttttttttttt

SEQ ID NO: 5818 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnttggatcgnntttttttttttttttttttttttttttttt

SEQ ID NO: 5819 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntggaacganntttttttttttttttttttttttttttttt

SEQ ID NO: 5820 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnggcaatcanntttttttttttttttttttttttttttttt

SEQ ID NO: 5821 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngaatccganntttttttttttttttttttttttttttttt

SEQ ID NO: 5822 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnttacggtgnntttttttttttttttttttttttttttttt

SEQ ID NO: 5823 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncatatcggnntttttttttttttttttttttttttttttt

SEQ ID NO: 5824 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncttcggtanntttttttttttttttttttttttttttttt

SEQ ID NO: 5825 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntcctaacgnntttttttttttttttttttttttttttttt

SEQ ID NO: 5826 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngtaagccanntttttttttttttttttttttttttttttt

SEQ ID NO: 5827 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntaaggtggnntttttttttttttttttttttttttttttt

SEQ ID NO: 5828 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnggtaagctnntttttttttttttttttttttttttttttt

SEQ ID NO: 5829 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntgtgtcganntttttttttttttttttttttttttttttt

SEQ ID NO: 5830 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngagcatganntttttttttttttttttttttttttttttt

SEQ ID NO: 5831 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntcgaagtcnntttttttttttttttttttttttttttttt

SEQ ID NO: 5832 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnggtgaacanntttttttttttttttttttttttttttttt

SEQ ID NO: 5833 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnacatgcacnntttttttttttttttttttttttttttttt

SEQ ID NO: 5834 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnccaacagtnntttttttttttttttttttttttttttttt

SEQ ID NO: 5835 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnagaacagcnntttttttttttttttttttttttttttttt

SEQ ID NO: 5836 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngaacacgtnntttttttttttttttttttttttttttttt

SEQ ID NO: 5837 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnggtcttcanntttttttttttttttttttttttttttttt

SEQ ID NO: 5838 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnaggttcagnntttttttttttttttttttttttttttttt

SEQ ID NO: 5839 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnctagagcanntttttttttttttttttttttttttttttt

SEQ ID NO: 5840 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncttctagcnntttttttttttttttttttttttttttttt

SEQ ID NO: 5841 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngagtaacgnntttttttttttttttttttttttttttttt

SEQ ID NO: 5842 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnctaagaggnntttttttttttttttttttttttttttttt

SEQ ID NO: 5843 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnacgtgtagnntttttttttttttttttttttttttttttt

SEQ ID NO: 5844 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnactacaggnntttttttttttttttttttttttttttttt

SEQ ID NO: 5845 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntacaggtcnntttttttttttttttttttttttttttttt

SEQ ID NO: 5846 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnctcacatgnntttttttttttttttttttttttttttttt

SEQ ID NO: 5847 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnactaggagnntttttttttttttttttttttttttttttt

SEQ ID NO: 5848 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnccatagganntttttttttttttttttttttttttttttt

SEQ ID NO: 5849 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnggagaatcnntttttttttttttttttttttttttttttt

SEQ ID NO: 5850 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngccaagaanntttttttttttttttttttttttttttttt

SEQ ID NO: 5851 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnaaggcaagnntttttttttttttttttttttttttttttt

SEQ ID NO: 5852 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnaatgtcgcnntttttttttttttttttttttttttttttt

SEQ ID NO: 5853 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnatggaaccnntttttttttttttttttttttttttttttt

SEQ ID NO: 5854 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnagaggcatnntttttttttttttttttttttttttttttt

SEQ ID NO: 5855 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntgcatagcnntttttttttttttttttttttttttttttt

SEQ ID NO: 5856 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnctaacgganntttttttttttttttttttttttttttttt

SEQ ID NO: 5857 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntatcgaggnntttttttttttttttttttttttttttttt

SEQ ID NO: 5858 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncatagcctnntttttttttttttttttttttttttttttt

SEQ ID NO: 5859 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnatcgagacnntttttttttttttttttttttttttttttt

SEQ ID NO: 5860 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnggaagagtnntttttttttttttttttttttttttttttt

SEQ ID NO: 5861 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnccaagtagnntttttttttttttttttttttttttttttt

SEQ ID NO: 5862 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnctgaacagnntttttttttttttttttttttttttttttt

SEQ ID NO: 5863 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngtaggttcnntttttttttttttttttttttttttttttt

SEQ ID NO: 5864 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngtatggacnntttttttttttttttttttttttttttttt

SEQ ID NO: 5865 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntcgcaacanntttttttttttttttttttttttttttttt

SEQ ID NO: 5866 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnccgctaatnntttttttttttttttttttttttttttttt

SEQ ID NO: 5867 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngattcgcanntttttttttttttttttttttttttttttt

SEQ ID NO: 5868 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncgatggaanntttttttttttttttttttttttttttttt

SEQ ID NO: 5869 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnagcaagganntttttttttttttttttttttttttttttt

SEQ ID NO: 5870 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncgtagcaanntttttttttttttttttttttttttttttt

SEQ ID NO: 5871 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntggcagtanntttttttttttttttttttttttttttttt

SEQ ID NO: 5872 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncggtagttnntttttttttttttttttttttttttttttt

SEQ ID NO: 5873 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntgacttcgnntttttttttttttttttttttttttttttt

SEQ ID NO: 5874 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngagtgcaanntttttttttttttttttttttttttttttt

SEQ ID NO: 5875 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnacggtaacnntttttttttttttttttttttttttttttt

SEQ ID NO: 5876 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnaagtggtgnntttttttttttttttttttttttttttttt

SEQ ID NO: 5877 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnggagacaanntttttttttttttttttttttttttttttt

SEQ ID NO: 5878 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntcaaggacnntttttttttttttttttttttttttttttt

SEQ ID NO: 5879 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnaagagagcnntttttttttttttttttttttttttttttt

SEQ ID NO: 5880 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncgagagatnntttttttttttttttttttttttttttttt

SEQ ID NO: 5881 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnacagatggnntttttttttttttttttttttttttttttt

SEQ ID NO: 5882 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnaggagtcanntttttttttttttttttttttttttttttt

SEQ ID NO: 5883 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncgtgttacnntttttttttttttttttttttttttttttt

SEQ ID NO: 5884 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntagtgtgcnntttttttttttttttttttttttttttttt

SEQ ID NO: 5885 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnctcatgacnntttttttttttttttttttttttttttttt

SEQ ID NO: 5886 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngtatccagnntttttttttttttttttttttttttttttt

SEQ ID NO: 5887 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnacgcctatnntttttttttttttttttttttttttttttt

SEQ ID NO: 5888 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnaacgacctnntttttttttttttttttttttttttttttt

SEQ ID NO: 5889 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnatcaggctnntttttttttttttttttttttttttttttt

SEQ ID NO: 5890 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncaagttcgnntttttttttttttttttttttttttttttt

SEQ ID NO: 5891 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntagccaganntttttttttttttttttttttttttttttt

SEQ ID NO: 5892 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncaatcacgnntttttttttttttttttttttttttttttt

SEQ ID NO: 5893 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnngcaacaagnntttttttttttttttttttttttttttttt

SEQ ID NO: 5894 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncacgacaanntttttttttttttttttttttttttttttt

SEQ ID NO: 5895 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntacggaganntttttttttttttttttttttttttttttt

SEQ ID NO: 5896 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncgacaaganntttttttttttttttttttttttttttttt

SEQ ID NO: 5897 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncgaagtganntttttttttttttttttttttttttttttt

SEQ ID NO: 5898 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnagctggtanntttttttttttttttttttttttttttttt

SEQ ID NO: 5899 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnaactaggcnntttttttttttttttttttttttttttttt

SEQ ID NO: 5900 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncagcaagtnntttttttttttttttttttttttttttttt

SEQ ID NO: 5901 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnacgaggtanntttttttttttttttttttttttttttttt

SEQ ID NO: 5902 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncatcttccnntttttttttttttttttttttttttttttt

SEQ ID NO: 5903 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncctgaatcnntttttttttttttttttttttttttttttt

SEQ ID NO: 5904 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnntgcagactnntttttttttttttttttttttttttttttt

SEQ ID NO: 5905 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnagatgtggnntttttttttttttttttttttttttttttt

SEQ ID NO: 5906 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnagttcgacnntttttttttttttttttttttttttttttt

SEQ ID NO: 5907 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnnacaacctcnntttttttttttttttttttttttttttttt

SEQ ID NO: 5908 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncatggtagnntttttttttttttttttttttttttttttt

SEQ ID NO: 5909 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncgtatctcnntttttttttttttttttttttttttttttt

SEQ ID NO: 5910 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncctagttcnntttttttttttttttttttttttttttttt

SEQ ID NO: 5911 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnactaaccgnncaagagtcnntttttttttttttttttttttttttttttt

SEQ ID NO: 5912 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannaatcggcanntttttttttttttttttttttttttttttt

SEQ ID NO: 5913 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntacggcatnntttttttttttttttttttttttttttttt

SEQ ID NO: 5914 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannttggatcgnntttttttttttttttttttttttttttttt

SEQ ID NO: 5915 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntggaacganntttttttttttttttttttttttttttttt

SEQ ID NO: 5916 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannggcaatcanntttttttttttttttttttttttttttttt

SEQ ID NO: 5917 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngaatccganntttttttttttttttttttttttttttttt

SEQ ID NO: 5918 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannttacggtgnntttttttttttttttttttttttttttttt

SEQ ID NO: 5919 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncatatcggnntttttttttttttttttttttttttttttt

SEQ ID NO: 5920 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncttcggtanntttttttttttttttttttttttttttttt

SEQ ID NO: 5921 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntcctaacgnntttttttttttttttttttttttttttttt

SEQ ID NO: 5922 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngtaagccanntttttttttttttttttttttttttttttt

SEQ ID NO: 5923 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntaaggtggnntttttttttttttttttttttttttttttt

SEQ ID NO: 5924 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannggtaagctnntttttttttttttttttttttttttttttt

SEQ ID NO: 5925 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntgtgtcganntttttttttttttttttttttttttttttt

SEQ ID NO: 5926 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngagcatganntttttttttttttttttttttttttttttt

SEQ ID NO: 5927 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntcgaagtcnntttttttttttttttttttttttttttttt

SEQ ID NO: 5928 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannggtgaacanntttttttttttttttttttttttttttttt

SEQ ID NO: 5929 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannacatgcacnntttttttttttttttttttttttttttttt

SEQ ID NO: 5930 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannccaacagtnntttttttttttttttttttttttttttttt

SEQ ID NO: 5931 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannagaacagcnntttttttttttttttttttttttttttttt

SEQ ID NO: 5932 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngaacacgtnntttttttttttttttttttttttttttttt

SEQ ID NO: 5933 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannggtcttcanntttttttttttttttttttttttttttttt

SEQ ID NO: 5934 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannaggttcagnntttttttttttttttttttttttttttttt

SEQ ID NO: 5935 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannctagagcanntttttttttttttttttttttttttttttt

SEQ ID NO: 5936 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncttctagcnntttttttttttttttttttttttttttttt

SEQ ID NO: 5937 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngagtaacgnntttttttttttttttttttttttttttttt

SEQ ID NO: 5938 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannctaagaggnntttttttttttttttttttttttttttttt

SEQ ID NO: 5939 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannacgtgtagnntttttttttttttttttttttttttttttt

SEQ ID NO: 5940 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannactacaggnntttttttttttttttttttttttttttttt

SEQ ID NO: 5941 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntacaggtcnntttttttttttttttttttttttttttttt

SEQ ID NO: 5942 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannctcacatgnntttttttttttttttttttttttttttttt

SEQ ID NO: 5943 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannactaggagnntttttttttttttttttttttttttttttt

SEQ ID NO: 5944 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannccatagganntttttttttttttttttttttttttttttt

SEQ ID NO: 5945 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannggagaatcnntttttttttttttttttttttttttttttt

SEQ ID NO: 5946 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngccaagaanntttttttttttttttttttttttttttttt

SEQ ID NO: 5947 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannaaggcaagnntttttttttttttttttttttttttttttt

SEQ ID NO: 5948 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannaatgtcgcnntttttttttttttttttttttttttttttt

SEQ ID NO: 5949 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannatggaaccnntttttttttttttttttttttttttttttt

SEQ ID NO: 5950 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannagaggcatnntttttttttttttttttttttttttttttt

SEQ ID NO: 5951 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntgcatagcnntttttttttttttttttttttttttttttt

SEQ ID NO: 5952 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannctaacgganntttttttttttttttttttttttttttttt

SEQ ID NO: 5953 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntatcgaggnntttttttttttttttttttttttttttttt

SEQ ID NO: 5954 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncatagcctnntttttttttttttttttttttttttttttt

SEQ ID NO: 5955 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannatcgagacnntttttttttttttttttttttttttttttt

SEQ ID NO: 5956 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannggaagagtnntttttttttttttttttttttttttttttt

SEQ ID NO: 5957 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannccaagtagnntttttttttttttttttttttttttttttt

SEQ ID NO: 5958 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannctgaacagnntttttttttttttttttttttttttttttt

SEQ ID NO: 5959 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngtaggttcnntttttttttttttttttttttttttttttt

SEQ ID NO: 5960 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngtatggacnntttttttttttttttttttttttttttttt

SEQ ID NO: 5961 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntcgcaacanntttttttttttttttttttttttttttttt

SEQ ID NO: 5962 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannccgctaatnntttttttttttttttttttttttttttttt

SEQ ID NO: 5963 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngattcgcanntttttttttttttttttttttttttttttt

SEQ ID NO: 5964 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncgatggaanntttttttttttttttttttttttttttttt

SEQ ID NO: 5965 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannagcaagganntttttttttttttttttttttttttttttt

SEQ ID NO: 5966 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncgtagcaanntttttttttttttttttttttttttttttt

SEQ ID NO: 5967 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntggcagtanntttttttttttttttttttttttttttttt

SEQ ID NO: 5968 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncggtagttnntttttttttttttttttttttttttttttt

SEQ ID NO: 5969 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntgacttcgnntttttttttttttttttttttttttttttt

SEQ ID NO: 5970 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngagtgcaanntttttttttttttttttttttttttttttt

SEQ ID NO: 5971 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannacggtaacnntttttttttttttttttttttttttttttt

SEQ ID NO: 5972 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannaagtggtgnntttttttttttttttttttttttttttttt

SEQ ID NO: 5973 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannggagacaanntttttttttttttttttttttttttttttt

SEQ ID NO: 5974 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntcaaggacnntttttttttttttttttttttttttttttt

SEQ ID NO: 5975 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannaagagagcnntttttttttttttttttttttttttttttt

SEQ ID NO: 5976 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncgagagatnntttttttttttttttttttttttttttttt

SEQ ID NO: 5977 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannacagatggnntttttttttttttttttttttttttttttt

SEQ ID NO: 5978 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannaggagtcanntttttttttttttttttttttttttttttt

SEQ ID NO: 5979 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncgtgttacnntttttttttttttttttttttttttttttt

SEQ ID NO: 5980 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntagtgtgcnntttttttttttttttttttttttttttttt

SEQ ID NO: 5981 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannctcatgacnntttttttttttttttttttttttttttttt

SEQ ID NO: 5982 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngtatccagnntttttttttttttttttttttttttttttt

SEQ ID NO: 5983 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannacgcctatnntttttttttttttttttttttttttttttt

SEQ ID NO: 5984 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannaacgacctnntttttttttttttttttttttttttttttt

SEQ ID NO: 5985 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannatcaggctnntttttttttttttttttttttttttttttt

SEQ ID NO: 5986 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncaagttcgnntttttttttttttttttttttttttttttt

SEQ ID NO: 5987 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntagccaganntttttttttttttttttttttttttttttt

SEQ ID NO: 5988 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncaatcacgnntttttttttttttttttttttttttttttt

SEQ ID NO: 5989 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanngcaacaagnntttttttttttttttttttttttttttttt

SEQ ID NO: 5990 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncacgacaanntttttttttttttttttttttttttttttt

SEQ ID NO: 5991 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntacggaganntttttttttttttttttttttttttttttt

SEQ ID NO: 5992 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncgacaaganntttttttttttttttttttttttttttttt

SEQ ID NO: 5993 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncgaagtganntttttttttttttttttttttttttttttt

SEQ ID NO: 5994 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannagctggtanntttttttttttttttttttttttttttttt

SEQ ID NO: 5995 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannaactaggcnntttttttttttttttttttttttttttttt

SEQ ID NO: 5996 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncagcaagtnntttttttttttttttttttttttttttttt

SEQ ID NO: 5997 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannacgaggtanntttttttttttttttttttttttttttttt

SEQ ID NO: 5998 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncatcttccnntttttttttttttttttttttttttttttt

SEQ ID NO: 5999 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncctgaatcnntttttttttttttttttttttttttttttt

SEQ ID NO: 6000 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanntgcagactnntttttttttttttttttttttttttttttt

SEQ ID NO: 6001 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannagatgtggnntttttttttttttttttttttttttttttt

SEQ ID NO: 6002 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannagttcgacnntttttttttttttttttttttttttttttt

SEQ ID NO: 6003 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaannacaacctcnntttttttttttttttttttttttttttttt

SEQ ID NO: 6004 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncatggtagnntttttttttttttttttttttttttttttt

SEQ ID NO: 6005 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncgtatctcnntttttttttttttttttttttttttttttt

SEQ ID NO: 6006 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncctagttcnntttttttttttttttttttttttttttttt

SEQ ID NO: 6007 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngtgcacaanncaagagtcnntttttttttttttttttttttttttttttt

SEQ ID NO: 6008 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannaatcggcanntttttttttttttttttttttttttttttt

SEQ ID NO: 6009 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntacggcatnntttttttttttttttttttttttttttttt

SEQ ID NO: 6010 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannttggatcgnntttttttttttttttttttttttttttttt

SEQ ID NO: 6011 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntggaacganntttttttttttttttttttttttttttttt

SEQ ID NO: 6012 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannggcaatcanntttttttttttttttttttttttttttttt

SEQ ID NO: 6013 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngaatccganntttttttttttttttttttttttttttttt

SEQ ID NO: 6014 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannttacggtgnntttttttttttttttttttttttttttttt

SEQ ID NO: 6015 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncatatcggnntttttttttttttttttttttttttttttt

SEQ ID NO: 6016 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncttcggtanntttttttttttttttttttttttttttttt

SEQ ID NO: 6017 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntcctaacgnntttttttttttttttttttttttttttttt

SEQ ID NO: 6018 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngtaagccanntttttttttttttttttttttttttttttt

SEQ ID NO: 6019 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntaaggtggnntttttttttttttttttttttttttttttt

SEQ ID NO: 6020 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannggtaagctnntttttttttttttttttttttttttttttt

SEQ ID NO: 6021 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntgtgtcganntttttttttttttttttttttttttttttt

SEQ ID NO: 6022 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngagcatganntttttttttttttttttttttttttttttt

SEQ ID NO: 6023 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntcgaagtcnntttttttttttttttttttttttttttttt

SEQ ID NO: 6024 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannggtgaacanntttttttttttttttttttttttttttttt

SEQ ID NO: 6025 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannacatgcacnntttttttttttttttttttttttttttttt

SEQ ID NO: 6026 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannccaacagtnntttttttttttttttttttttttttttttt

SEQ ID NO: 6027 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannagaacagcnntttttttttttttttttttttttttttttt

SEQ ID NO: 6028 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngaacacgtnntttttttttttttttttttttttttttttt

SEQ ID NO: 6029 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannggtcttcanntttttttttttttttttttttttttttttt

SEQ ID NO: 6030 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannaggttcagnntttttttttttttttttttttttttttttt

SEQ ID NO: 6031 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannctagagcanntttttttttttttttttttttttttttttt

SEQ ID NO: 6032 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncttctagcnntttttttttttttttttttttttttttttt

SEQ ID NO: 6033 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngagtaacgnntttttttttttttttttttttttttttttt

SEQ ID NO: 6034 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannctaagaggnntttttttttttttttttttttttttttttt

SEQ ID NO: 6035 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannacgtgtagnntttttttttttttttttttttttttttttt

SEQ ID NO: 6036 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannactacaggnntttttttttttttttttttttttttttttt

SEQ ID NO: 6037 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntacaggtcnntttttttttttttttttttttttttttttt

SEQ ID NO: 6038 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannctcacatgnntttttttttttttttttttttttttttttt

SEQ ID NO: 6039 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannactaggagnntttttttttttttttttttttttttttttt

SEQ ID NO: 6040 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannccatagganntttttttttttttttttttttttttttttt

SEQ ID NO: 6041 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannggagaatcnntttttttttttttttttttttttttttttt

SEQ ID NO: 6042 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngccaagaanntttttttttttttttttttttttttttttt

SEQ ID NO: 6043 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannaaggcaagnntttttttttttttttttttttttttttttt

SEQ ID NO: 6044 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannaatgtcgcnntttttttttttttttttttttttttttttt

SEQ ID NO: 6045 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannatggaaccnntttttttttttttttttttttttttttttt

SEQ ID NO: 6046 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannagaggcatnntttttttttttttttttttttttttttttt

SEQ ID NO: 6047 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntgcatagcnntttttttttttttttttttttttttttttt

SEQ ID NO: 6048 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannctaacgganntttttttttttttttttttttttttttttt

SEQ ID NO: 6049 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntatcgaggnntttttttttttttttttttttttttttttt

SEQ ID NO: 6050 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncatagcctnntttttttttttttttttttttttttttttt

SEQ ID NO: 6051 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannatcgagacnntttttttttttttttttttttttttttttt

SEQ ID NO: 6052 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannggaagagtnntttttttttttttttttttttttttttttt

SEQ ID NO: 6053 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannccaagtagnntttttttttttttttttttttttttttttt

SEQ ID NO: 6054 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannctgaacagnntttttttttttttttttttttttttttttt

SEQ ID NO: 6055 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngtaggttcnntttttttttttttttttttttttttttttt

SEQ ID NO: 6056 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngtatggacnntttttttttttttttttttttttttttttt

SEQ ID NO: 6057 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntcgcaacanntttttttttttttttttttttttttttttt

SEQ ID NO: 6058 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannccgctaatnntttttttttttttttttttttttttttttt

SEQ ID NO: 6059 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngattcgcanntttttttttttttttttttttttttttttt

SEQ ID NO: 6060 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncgatggaanntttttttttttttttttttttttttttttt

SEQ ID NO: 6061 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannagcaagganntttttttttttttttttttttttttttttt

SEQ ID NO: 6062 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncgtagcaanntttttttttttttttttttttttttttttt

SEQ ID NO: 6063 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntggcagtanntttttttttttttttttttttttttttttt

SEQ ID NO: 6064 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncggtagttnntttttttttttttttttttttttttttttt

SEQ ID NO: 6065 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntgacttcgnntttttttttttttttttttttttttttttt

SEQ ID NO: 6066 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngagtgcaanntttttttttttttttttttttttttttttt

SEQ ID NO: 6067 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannacggtaacnntttttttttttttttttttttttttttttt

SEQ ID NO: 6068 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannaagtggtgnntttttttttttttttttttttttttttttt

SEQ ID NO: 6069 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannggagacaanntttttttttttttttttttttttttttttt

SEQ ID NO: 6070 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntcaaggacnntttttttttttttttttttttttttttttt

SEQ ID NO: 6071 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannaagagagcnntttttttttttttttttttttttttttttt

SEQ ID NO: 6072 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncgagagatnntttttttttttttttttttttttttttttt

SEQ ID NO: 6073 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannacagatggnntttttttttttttttttttttttttttttt

SEQ ID NO: 6074 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannaggagtcanntttttttttttttttttttttttttttttt

SEQ ID NO: 6075 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncgtgttacnntttttttttttttttttttttttttttttt

SEQ ID NO: 6076 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntagtgtgcnntttttttttttttttttttttttttttttt

SEQ ID NO: 6077 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannctcatgacnntttttttttttttttttttttttttttttt

SEQ ID NO: 6078 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngtatccagnntttttttttttttttttttttttttttttt

SEQ ID NO: 6079 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannacgcctatnntttttttttttttttttttttttttttttt

SEQ ID NO: 6080 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannaacgacctnntttttttttttttttttttttttttttttt

SEQ ID NO: 6081 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannatcaggctnntttttttttttttttttttttttttttttt

SEQ ID NO: 6082 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncaagttcgnntttttttttttttttttttttttttttttt

SEQ ID NO: 6083 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntagccaganntttttttttttttttttttttttttttttt

SEQ ID NO: 6084 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncaatcacgnntttttttttttttttttttttttttttttt

SEQ ID NO: 6085 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanngcaacaagnntttttttttttttttttttttttttttttt

SEQ ID NO: 6086 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncacgacaanntttttttttttttttttttttttttttttt

SEQ ID NO: 6087 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntacggaganntttttttttttttttttttttttttttttt

SEQ ID NO: 6088 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncgacaaganntttttttttttttttttttttttttttttt

SEQ ID NO: 6089 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncgaagtganntttttttttttttttttttttttttttttt

SEQ ID NO: 6090 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannagctggtanntttttttttttttttttttttttttttttt

SEQ ID NO: 6091 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannaactaggcnntttttttttttttttttttttttttttttt

SEQ ID NO: 6092 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncagcaagtnntttttttttttttttttttttttttttttt

SEQ ID NO: 6093 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannacgaggtanntttttttttttttttttttttttttttttt

SEQ ID NO: 6094 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncatcttccnntttttttttttttttttttttttttttttt

SEQ ID NO: 6095 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncctgaatcnntttttttttttttttttttttttttttttt

SEQ ID NO: 6096 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanntgcagactnntttttttttttttttttttttttttttttt

SEQ ID NO: 6097 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannagatgtggnntttttttttttttttttttttttttttttt

SEQ ID NO: 6098 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannagttcgacnntttttttttttttttttttttttttttttt

SEQ ID NO: 6099 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccannacaacctcnntttttttttttttttttttttttttttttt

SEQ ID NO: 6100 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncatggtagnntttttttttttttttttttttttttttttt

SEQ ID NO: 6101 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncgtatctcnntttttttttttttttttttttttttttttt

SEQ ID NO: 6102 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncctagttcnntttttttttttttttttttttttttttttt

SEQ ID NO: 6103 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctatccanncaagagtcnntttttttttttttttttttttttttttttt

SEQ ID NO: 6104 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannaatcggcanntttttttttttttttttttttttttttttt

SEQ ID NO: 6105 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntacggcatnntttttttttttttttttttttttttttttt

SEQ ID NO: 6106 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannttggatcgnntttttttttttttttttttttttttttttt

SEQ ID NO: 6107 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntggaacganntttttttttttttttttttttttttttttt

SEQ ID NO: 6108 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannggcaatcanntttttttttttttttttttttttttttttt

SEQ ID NO: 6109 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngaatccganntttttttttttttttttttttttttttttt

SEQ ID NO: 6110 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannttacggtgnntttttttttttttttttttttttttttttt

SEQ ID NO: 6111 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncatatcggnntttttttttttttttttttttttttttttt

SEQ ID NO: 6112 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncttcggtanntttttttttttttttttttttttttttttt

SEQ ID NO: 6113 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntcctaacgnntttttttttttttttttttttttttttttt

SEQ ID NO: 6114 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngtaagccanntttttttttttttttttttttttttttttt

SEQ ID NO: 6115 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntaaggtggnntttttttttttttttttttttttttttttt

SEQ ID NO: 6116 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannggtaagctnntttttttttttttttttttttttttttttt

SEQ ID NO: 6117 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntgtgtcganntttttttttttttttttttttttttttttt

SEQ ID NO: 6118 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngagcatganntttttttttttttttttttttttttttttt

SEQ ID NO: 6119 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntcgaagtcnntttttttttttttttttttttttttttttt

SEQ ID NO: 6120 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannggtgaacanntttttttttttttttttttttttttttttt

SEQ ID NO: 6121 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannacatgcacnntttttttttttttttttttttttttttttt

SEQ ID NO: 6122 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannccaacagtnntttttttttttttttttttttttttttttt

SEQ ID NO: 6123 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannagaacagcnntttttttttttttttttttttttttttttt

SEQ ID NO: 6124 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngaacacgtnntttttttttttttttttttttttttttttt

SEQ ID NO: 6125 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannggtcttcanntttttttttttttttttttttttttttttt

SEQ ID NO: 6126 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannaggttcagnntttttttttttttttttttttttttttttt

SEQ ID NO: 6127 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannctagagcanntttttttttttttttttttttttttttttt

SEQ ID NO: 6128 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncttctagcnntttttttttttttttttttttttttttttt

SEQ ID NO: 6129 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngagtaacgnntttttttttttttttttttttttttttttt

SEQ ID NO: 6130 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannctaagaggnntttttttttttttttttttttttttttttt

SEQ ID NO: 6131 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannacgtgtagnntttttttttttttttttttttttttttttt

SEQ ID NO: 6132 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannactacaggnntttttttttttttttttttttttttttttt

SEQ ID NO: 6133 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntacaggtcnntttttttttttttttttttttttttttttt

SEQ ID NO: 6134 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannctcacatgnntttttttttttttttttttttttttttttt

SEQ ID NO: 6135 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannactaggagnntttttttttttttttttttttttttttttt

SEQ ID NO: 6136 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannccatagganntttttttttttttttttttttttttttttt

SEQ ID NO: 6137 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannggagaatcnntttttttttttttttttttttttttttttt

SEQ ID NO: 6138 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngccaagaanntttttttttttttttttttttttttttttt

SEQ ID NO: 6139 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannaaggcaagnntttttttttttttttttttttttttttttt

SEQ ID NO: 6140 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannaatgtcgcnntttttttttttttttttttttttttttttt

SEQ ID NO: 6141 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannatggaaccnntttttttttttttttttttttttttttttt

SEQ ID NO: 6142 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannagaggcatnntttttttttttttttttttttttttttttt

SEQ ID NO: 6143 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntgcatagcnntttttttttttttttttttttttttttttt

SEQ ID NO: 6144 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannctaacgganntttttttttttttttttttttttttttttt

SEQ ID NO: 6145 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntatcgaggnntttttttttttttttttttttttttttttt

SEQ ID NO: 6146 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncatagcctnntttttttttttttttttttttttttttttt

SEQ ID NO: 6147 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannatcgagacnntttttttttttttttttttttttttttttt

SEQ ID NO: 6148 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannggaagagtnntttttttttttttttttttttttttttttt

SEQ ID NO: 6149 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannccaagtagnntttttttttttttttttttttttttttttt

SEQ ID NO: 6150 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannctgaacagnntttttttttttttttttttttttttttttt

SEQ ID NO: 6151 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngtaggttcnntttttttttttttttttttttttttttttt

SEQ ID NO: 6152 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngtatggacnntttttttttttttttttttttttttttttt

SEQ ID NO: 6153 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntcgcaacanntttttttttttttttttttttttttttttt

SEQ ID NO: 6154 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannccgctaatnntttttttttttttttttttttttttttttt

SEQ ID NO: 6155 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngattcgcanntttttttttttttttttttttttttttttt

SEQ ID NO: 6156 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncgatggaanntttttttttttttttttttttttttttttt

SEQ ID NO: 6157 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannagcaagganntttttttttttttttttttttttttttttt

SEQ ID NO: 6158 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncgtagcaanntttttttttttttttttttttttttttttt

SEQ ID NO: 6159 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntggcagtanntttttttttttttttttttttttttttttt

SEQ ID NO: 6160 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncggtagttnntttttttttttttttttttttttttttttt

SEQ ID NO: 6161 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntgacttcgnntttttttttttttttttttttttttttttt

SEQ ID NO: 6162 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngagtgcaanntttttttttttttttttttttttttttttt

SEQ ID NO: 6163 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannacggtaacnntttttttttttttttttttttttttttttt

SEQ ID NO: 6164 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannaagtggtgnntttttttttttttttttttttttttttttt

SEQ ID NO: 6165 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannggagacaanntttttttttttttttttttttttttttttt

SEQ ID NO: 6166 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntcaaggacnntttttttttttttttttttttttttttttt

SEQ ID NO: 6167 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannaagagagcnntttttttttttttttttttttttttttttt

SEQ ID NO: 6168 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncgagagatnntttttttttttttttttttttttttttttt

SEQ ID NO: 6169 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannacagatggnntttttttttttttttttttttttttttttt

SEQ ID NO: 6170 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannaggagtcanntttttttttttttttttttttttttttttt

SEQ ID NO: 6171 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncgtgttacnntttttttttttttttttttttttttttttt

SEQ ID NO: 6172 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntagtgtgcnntttttttttttttttttttttttttttttt

SEQ ID NO: 6173 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannctcatgacnntttttttttttttttttttttttttttttt

SEQ ID NO: 6174 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngtatccagnntttttttttttttttttttttttttttttt

SEQ ID NO: 6175 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannacgcctatnntttttttttttttttttttttttttttttt

SEQ ID NO: 6176 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannaacgacctnntttttttttttttttttttttttttttttt

SEQ ID NO: 6177 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannatcaggctnntttttttttttttttttttttttttttttt

SEQ ID NO: 6178 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncaagttcgnntttttttttttttttttttttttttttttt

SEQ ID NO: 6179 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntagccaganntttttttttttttttttttttttttttttt

SEQ ID NO: 6180 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncaatcacgnntttttttttttttttttttttttttttttt

SEQ ID NO: 6181 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanngcaacaagnntttttttttttttttttttttttttttttt

SEQ ID NO: 6182 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncacgacaanntttttttttttttttttttttttttttttt

SEQ ID NO: 6183 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntacggaganntttttttttttttttttttttttttttttt

SEQ ID NO: 6184 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncgacaaganntttttttttttttttttttttttttttttt

SEQ ID NO: 6185 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncgaagtganntttttttttttttttttttttttttttttt

SEQ ID NO: 6186 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannagctggtanntttttttttttttttttttttttttttttt

SEQ ID NO: 6187 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannaactaggcnntttttttttttttttttttttttttttttt

SEQ ID NO: 6188 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncagcaagtnntttttttttttttttttttttttttttttt

SEQ ID NO: 6189 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannacgaggtanntttttttttttttttttttttttttttttt

SEQ ID NO: 6190 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncatcttccnntttttttttttttttttttttttttttttt

SEQ ID NO: 6191 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncctgaatcnntttttttttttttttttttttttttttttt

SEQ ID NO: 6192 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanntgcagactnntttttttttttttttttttttttttttttt

SEQ ID NO: 6193 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannagatgtggnntttttttttttttttttttttttttttttt

SEQ ID NO: 6194 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannagttcgacnntttttttttttttttttttttttttttttt

SEQ ID NO: 6195 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacannacaacctcnntttttttttttttttttttttttttttttt

SEQ ID NO: 6196 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncatggtagnntttttttttttttttttttttttttttttt

SEQ ID NO: 6197 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncgtatctcnntttttttttttttttttttttttttttttt

SEQ ID NO: 6198 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncctagttcnntttttttttttttttttttttttttttttt

SEQ ID NO: 6199 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncttggacanncaagagtcnntttttttttttttttttttttttttttttt

SEQ ID NO: 6200 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnaatcggcanntttttttttttttttttttttttttttttt

SEQ ID NO: 6201 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntacggcatnntttttttttttttttttttttttttttttt

SEQ ID NO: 6202 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnttggatcgnntttttttttttttttttttttttttttttt

SEQ ID NO: 6203 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntggaacganntttttttttttttttttttttttttttttt

SEQ ID NO: 6204 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnggcaatcanntttttttttttttttttttttttttttttt

SEQ ID NO: 6205 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngaatccganntttttttttttttttttttttttttttttt

SEQ ID NO: 6206 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnttacggtgnntttttttttttttttttttttttttttttt

SEQ ID NO: 6207 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncatatcggnntttttttttttttttttttttttttttttt

SEQ ID NO: 6208 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncttcggtanntttttttttttttttttttttttttttttt

SEQ ID NO: 6209 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntcctaacgnntttttttttttttttttttttttttttttt

SEQ ID NO: 6210 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngtaagccanntttttttttttttttttttttttttttttt

SEQ ID NO: 6211 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntaaggtggnntttttttttttttttttttttttttttttt

SEQ ID NO: 6212 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnggtaagctnntttttttttttttttttttttttttttttt

SEQ ID NO: 6213 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntgtgtcganntttttttttttttttttttttttttttttt

SEQ ID NO: 6214 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngagcatganntttttttttttttttttttttttttttttt

SEQ ID NO: 6215 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntcgaagtcnntttttttttttttttttttttttttttttt

SEQ ID NO: 6216 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnggtgaacanntttttttttttttttttttttttttttttt

SEQ ID NO: 6217 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnacatgcacnntttttttttttttttttttttttttttttt

SEQ ID NO: 6218 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnccaacagtnntttttttttttttttttttttttttttttt

SEQ ID NO: 6219 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnagaacagcnntttttttttttttttttttttttttttttt

SEQ ID NO: 6220 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngaacacgtnntttttttttttttttttttttttttttttt

SEQ ID NO: 6221 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnggtcttcanntttttttttttttttttttttttttttttt

SEQ ID NO: 6222 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnaggttcagnntttttttttttttttttttttttttttttt

SEQ ID NO: 6223 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnctagagcanntttttttttttttttttttttttttttttt

SEQ ID NO: 6224 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncttctagcnntttttttttttttttttttttttttttttt

SEQ ID NO: 6225 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngagtaacgnntttttttttttttttttttttttttttttt

SEQ ID NO: 6226 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnctaagaggnntttttttttttttttttttttttttttttt

SEQ ID NO: 6227 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnacgtgtagnntttttttttttttttttttttttttttttt

SEQ ID NO: 6228 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnactacaggnntttttttttttttttttttttttttttttt

SEQ ID NO: 6229 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntacaggtcnntttttttttttttttttttttttttttttt

SEQ ID NO: 6230 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnctcacatgnntttttttttttttttttttttttttttttt

SEQ ID NO: 6231 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnactaggagnntttttttttttttttttttttttttttttt

SEQ ID NO: 6232 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnccatagganntttttttttttttttttttttttttttttt

SEQ ID NO: 6233 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnggagaatcnntttttttttttttttttttttttttttttt

SEQ ID NO: 6234 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngccaagaanntttttttttttttttttttttttttttttt

SEQ ID NO: 6235 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnaaggcaagnntttttttttttttttttttttttttttttt

SEQ ID NO: 6236 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnaatgtcgcnntttttttttttttttttttttttttttttt

SEQ ID NO: 6237 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnatggaaccnntttttttttttttttttttttttttttttt

SEQ ID NO: 6238 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnagaggcatnntttttttttttttttttttttttttttttt

SEQ ID NO: 6239 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntgcatagcnntttttttttttttttttttttttttttttt

SEQ ID NO: 6240 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnctaacgganntttttttttttttttttttttttttttttt

SEQ ID NO: 6241 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntatcgaggnntttttttttttttttttttttttttttttt

SEQ ID NO: 6242 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncatagcctnntttttttttttttttttttttttttttttt

SEQ ID NO: 6243 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnatcgagacnntttttttttttttttttttttttttttttt

SEQ ID NO: 6244 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnggaagagtnntttttttttttttttttttttttttttttt

SEQ ID NO: 6245 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnccaagtagnntttttttttttttttttttttttttttttt

SEQ ID NO: 6246 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnctgaacagnntttttttttttttttttttttttttttttt

SEQ ID NO: 6247 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngtaggttcnntttttttttttttttttttttttttttttt

SEQ ID NO: 6248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngtatggacnntttttttttttttttttttttttttttttt

SEQ ID NO: 6249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntcgcaacanntttttttttttttttttttttttttttttt

SEQ ID NO: 6250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnccgctaatnntttttttttttttttttttttttttttttt

SEQ ID NO: 6251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngattcgcanntttttttttttttttttttttttttttttt

SEQ ID NO: 6252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncgatggaanntttttttttttttttttttttttttttttt

SEQ ID NO: 6253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnagcaagganntttttttttttttttttttttttttttttt

SEQ ID NO: 6254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncgtagcaanntttttttttttttttttttttttttttttt

SEQ ID NO: 6255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntggcagtanntttttttttttttttttttttttttttttt

SEQ ID NO: 6256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncggtagttnntttttttttttttttttttttttttttttt

SEQ ID NO: 6257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntgacttcgnntttttttttttttttttttttttttttttt

SEQ ID NO: 6258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngagtgcaanntttttttttttttttttttttttttttttt

SEQ ID NO: 6259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnacggtaacnntttttttttttttttttttttttttttttt

SEQ ID NO: 6260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnaagtggtgnntttttttttttttttttttttttttttttt

SEQ ID NO: 6261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnggagacaanntttttttttttttttttttttttttttttt

SEQ ID NO: 6262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntcaaggacnntttttttttttttttttttttttttttttt

SEQ ID NO: 6263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnaagagagcnntttttttttttttttttttttttttttttt

SEQ ID NO: 6264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncgagagatnntttttttttttttttttttttttttttttt

SEQ ID NO: 6265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnacagatggnntttttttttttttttttttttttttttttt

SEQ ID NO: 6266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnaggagtcanntttttttttttttttttttttttttttttt

SEQ ID NO: 6267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncgtgttacnntttttttttttttttttttttttttttttt

SEQ ID NO: 6268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntagtgtgcnntttttttttttttttttttttttttttttt

SEQ ID NO: 6269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnctcatgacnntttttttttttttttttttttttttttttt

SEQ ID NO: 6270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngtatccagnntttttttttttttttttttttttttttttt

SEQ ID NO: 6271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnacgcctatnntttttttttttttttttttttttttttttt

SEQ ID NO: 6272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnaacgacctnntttttttttttttttttttttttttttttt

SEQ ID NO: 6273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnatcaggctnntttttttttttttttttttttttttttttt

SEQ ID NO: 6274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncaagttcgnntttttttttttttttttttttttttttttt

SEQ ID NO: 6275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntagccaganntttttttttttttttttttttttttttttt

SEQ ID NO: 6276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncaatcacgnntttttttttttttttttttttttttttttt

SEQ ID NO: 6277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnngcaacaagnntttttttttttttttttttttttttttttt

SEQ ID NO: 6278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncacgacaanntttttttttttttttttttttttttttttt

SEQ ID NO: 6279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntacggaganntttttttttttttttttttttttttttttt

SEQ ID NO: 6280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncgacaaganntttttttttttttttttttttttttttttt

SEQ ID NO: 6281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncgaagtganntttttttttttttttttttttttttttttt

SEQ ID NO: 6282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnagctggtanntttttttttttttttttttttttttttttt

SEQ ID NO: 6283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnaactaggcnntttttttttttttttttttttttttttttt

SEQ ID NO: 6284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncagcaagtnntttttttttttttttttttttttttttttt

SEQ ID NO: 6285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnacgaggtanntttttttttttttttttttttttttttttt

SEQ ID NO: 6286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncatcttccnntttttttttttttttttttttttttttttt

SEQ ID NO: 6287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncctgaatcnntttttttttttttttttttttttttttttt

SEQ ID NO: 6288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnntgcagactnntttttttttttttttttttttttttttttt

SEQ ID NO: 6289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnagatgtggnntttttttttttttttttttttttttttttt

SEQ ID NO: 6290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnagttcgacnntttttttttttttttttttttttttttttt

SEQ ID NO: 6291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnnacaacctcnntttttttttttttttttttttttttttttt

SEQ ID NO: 6292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncatggtagnntttttttttttttttttttttttttttttt

SEQ ID NO: 6293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncgtatctcnntttttttttttttttttttttttttttttt

SEQ ID NO: 6294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncctagttcnntttttttttttttttttttttttttttttt

SEQ ID NO: 6295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntggtcaagnncaagagtcnntttttttttttttttttttttttttttttt

SEQ ID NO: 6296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnaatcggcanntttttttttttttttttttttttttttttt

SEQ ID NO: 6297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntacggcatnntttttttttttttttttttttttttttttt

SEQ ID NO: 6298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnttggatcgnntttttttttttttttttttttttttttttt

SEQ ID NO: 6299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntggaacganntttttttttttttttttttttttttttttt

SEQ ID NO: 6300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnggcaatcanntttttttttttttttttttttttttttttt

SEQ ID NO: 6301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngaatccganntttttttttttttttttttttttttttttt

SEQ ID NO: 6302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnttacggtgnntttttttttttttttttttttttttttttt

SEQ ID NO: 6303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncatatcggnntttttttttttttttttttttttttttttt

SEQ ID NO: 6304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncttcggtanntttttttttttttttttttttttttttttt

SEQ ID NO: 6305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntcctaacgnntttttttttttttttttttttttttttttt

SEQ ID NO: 6306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngtaagccanntttttttttttttttttttttttttttttt

SEQ ID NO: 6307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntaaggtggnntttttttttttttttttttttttttttttt

SEQ ID NO: 6308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnggtaagctnntttttttttttttttttttttttttttttt

SEQ ID NO: 6309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntgtgtcganntttttttttttttttttttttttttttttt

SEQ ID NO: 6310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngagcatganntttttttttttttttttttttttttttttt

SEQ ID NO: 6311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntcgaagtcnntttttttttttttttttttttttttttttt

SEQ ID NO: 6312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnggtgaacanntttttttttttttttttttttttttttttt

SEQ ID NO: 6313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnacatgcacnntttttttttttttttttttttttttttttt

SEQ ID NO: 6314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnccaacagtnntttttttttttttttttttttttttttttt

SEQ ID NO: 6315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnagaacagcnntttttttttttttttttttttttttttttt

SEQ ID NO: 6316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngaacacgtnntttttttttttttttttttttttttttttt

SEQ ID NO: 6317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnggtcttcanntttttttttttttttttttttttttttttt

SEQ ID NO: 6318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnaggttcagnntttttttttttttttttttttttttttttt

SEQ ID NO: 6319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnctagagcanntttttttttttttttttttttttttttttt

SEQ ID NO: 6320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncttctagcnntttttttttttttttttttttttttttttt

SEQ ID NO: 6321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngagtaacgnntttttttttttttttttttttttttttttt

SEQ ID NO: 6322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnctaagaggnntttttttttttttttttttttttttttttt

SEQ ID NO: 6323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnacgtgtagnntttttttttttttttttttttttttttttt

SEQ ID NO: 6324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnactacaggnntttttttttttttttttttttttttttttt

SEQ ID NO: 6325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntacaggtcnntttttttttttttttttttttttttttttt

SEQ ID NO: 6326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnctcacatgnntttttttttttttttttttttttttttttt

SEQ ID NO: 6327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnactaggagnntttttttttttttttttttttttttttttt

SEQ ID NO: 6328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnccatagganntttttttttttttttttttttttttttttt

SEQ ID NO: 6329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnggagaatcnntttttttttttttttttttttttttttttt

SEQ ID NO: 6330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngccaagaanntttttttttttttttttttttttttttttt

SEQ ID NO: 6331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnaaggcaagnntttttttttttttttttttttttttttttt

SEQ ID NO: 6332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnaatgtcgcnntttttttttttttttttttttttttttttt

SEQ ID NO: 6333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnatggaaccnntttttttttttttttttttttttttttttt

SEQ ID NO: 6334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnagaggcatnntttttttttttttttttttttttttttttt

SEQ ID NO: 6335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntgcatagcnntttttttttttttttttttttttttttttt

SEQ ID NO: 6336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnctaacgganntttttttttttttttttttttttttttttt

SEQ ID NO: 6337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntatcgaggnntttttttttttttttttttttttttttttt

SEQ ID NO: 6338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncatagcctnntttttttttttttttttttttttttttttt

SEQ ID NO: 6339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnatcgagacnntttttttttttttttttttttttttttttt

SEQ ID NO: 6340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnggaagagtnntttttttttttttttttttttttttttttt

SEQ ID NO: 6341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnccaagtagnntttttttttttttttttttttttttttttt

SEQ ID NO: 6342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnctgaacagnntttttttttttttttttttttttttttttt

SEQ ID NO: 6343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngtaggttcnntttttttttttttttttttttttttttttt

SEQ ID NO: 6344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngtatggacnntttttttttttttttttttttttttttttt

SEQ ID NO: 6345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntcgcaacanntttttttttttttttttttttttttttttt

SEQ ID NO: 6346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnccgctaatnntttttttttttttttttttttttttttttt

SEQ ID NO: 6347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngattcgcanntttttttttttttttttttttttttttttt

SEQ ID NO: 6348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncgatggaanntttttttttttttttttttttttttttttt

SEQ ID NO: 6349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnagcaagganntttttttttttttttttttttttttttttt

SEQ ID NO: 6350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncgtagcaanntttttttttttttttttttttttttttttt

SEQ ID NO: 6351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntggcagtanntttttttttttttttttttttttttttttt

SEQ ID NO: 6352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncggtagttnntttttttttttttttttttttttttttttt

SEQ ID NO: 6353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntgacttcgnntttttttttttttttttttttttttttttt

SEQ ID NO: 6354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngagtgcaanntttttttttttttttttttttttttttttt

SEQ ID NO: 6355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnacggtaacnntttttttttttttttttttttttttttttt

SEQ ID NO: 6356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnaagtggtgnntttttttttttttttttttttttttttttt

SEQ ID NO: 6357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnggagacaanntttttttttttttttttttttttttttttt

SEQ ID NO: 6358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntcaaggacnntttttttttttttttttttttttttttttt

SEQ ID NO: 6359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnaagagagcnntttttttttttttttttttttttttttttt

SEQ ID NO: 6360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncgagagatnntttttttttttttttttttttttttttttt

SEQ ID NO: 6361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnacagatggnntttttttttttttttttttttttttttttt

SEQ ID NO: 6362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnaggagtcanntttttttttttttttttttttttttttttt

SEQ ID NO: 6363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncgtgttacnntttttttttttttttttttttttttttttt

SEQ ID NO: 6364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntagtgtgcnntttttttttttttttttttttttttttttt

SEQ ID NO: 6365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnctcatgacnntttttttttttttttttttttttttttttt

SEQ ID NO: 6366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngtatccagnntttttttttttttttttttttttttttttt

SEQ ID NO: 6367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnacgcctatnntttttttttttttttttttttttttttttt

SEQ ID NO: 6368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnaacgacctnntttttttttttttttttttttttttttttt

SEQ ID NO: 6369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnatcaggctnntttttttttttttttttttttttttttttt

SEQ ID NO: 6370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncaagttcgnntttttttttttttttttttttttttttttt

SEQ ID NO: 6371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntagccaganntttttttttttttttttttttttttttttt

SEQ ID NO: 6372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncaatcacgnntttttttttttttttttttttttttttttt

SEQ ID NO: 6373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnngcaacaagnntttttttttttttttttttttttttttttt

SEQ ID NO: 6374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncacgacaanntttttttttttttttttttttttttttttt

SEQ ID NO: 6375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntacggaganntttttttttttttttttttttttttttttt

SEQ ID NO: 6376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncgacaaganntttttttttttttttttttttttttttttt

SEQ ID NO: 6377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncgaagtganntttttttttttttttttttttttttttttt

SEQ ID NO: 6378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnagctggtanntttttttttttttttttttttttttttttt

SEQ ID NO: 6379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnaactaggcnntttttttttttttttttttttttttttttt

SEQ ID NO: 6380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncagcaagtnntttttttttttttttttttttttttttttt

SEQ ID NO: 6381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnacgaggtanntttttttttttttttttttttttttttttt

SEQ ID NO: 6382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncatcttccnntttttttttttttttttttttttttttttt

SEQ ID NO: 6383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncctgaatcnntttttttttttttttttttttttttttttt

SEQ ID NO: 6384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnntgcagactnntttttttttttttttttttttttttttttt

SEQ ID NO: 6385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnagatgtggnntttttttttttttttttttttttttttttt

SEQ ID NO: 6386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnagttcgacnntttttttttttttttttttttttttttttt

SEQ ID NO: 6387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnnacaacctcnntttttttttttttttttttttttttttttt

SEQ ID NO: 6388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncatggtagnntttttttttttttttttttttttttttttt

SEQ ID NO: 6389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncgtatctcnntttttttttttttttttttttttttttttt

SEQ ID NO: 6390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncctagttcnntttttttttttttttttttttttttttttt

SEQ ID NO: 6391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaatgagcnncaagagtcnntttttttttttttttttttttttttttttt

SEQ ID NO: 6392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannaatcggcanntttttttttttttttttttttttttttttt

SEQ ID NO: 6393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntacggcatnntttttttttttttttttttttttttttttt

SEQ ID NO: 6394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannttggatcgnntttttttttttttttttttttttttttttt

SEQ ID NO: 6395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntggaacganntttttttttttttttttttttttttttttt

SEQ ID NO: 6396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannggcaatcanntttttttttttttttttttttttttttttt

SEQ ID NO: 6397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngaatccganntttttttttttttttttttttttttttttt

SEQ ID NO: 6398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannttacggtgnntttttttttttttttttttttttttttttt

SEQ ID NO: 6399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncatatcggnntttttttttttttttttttttttttttttt

SEQ ID NO: 6400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncttcggtanntttttttttttttttttttttttttttttt

SEQ ID NO: 6401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntcctaacgnntttttttttttttttttttttttttttttt

SEQ ID NO: 6402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngtaagccanntttttttttttttttttttttttttttttt

SEQ ID NO: 6403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntaaggtggnntttttttttttttttttttttttttttttt

SEQ ID NO: 6404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannggtaagctnntttttttttttttttttttttttttttttt

SEQ ID NO: 6405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntgtgtcganntttttttttttttttttttttttttttttt

SEQ ID NO: 6406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngagcatganntttttttttttttttttttttttttttttt

SEQ ID NO: 6407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntcgaagtcnntttttttttttttttttttttttttttttt

SEQ ID NO: 6408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannggtgaacanntttttttttttttttttttttttttttttt

SEQ ID NO: 6409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannacatgcacnntttttttttttttttttttttttttttttt

SEQ ID NO: 6410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannccaacagtnntttttttttttttttttttttttttttttt

SEQ ID NO: 6411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannagaacagcnntttttttttttttttttttttttttttttt

SEQ ID NO: 6412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngaacacgtnntttttttttttttttttttttttttttttt

SEQ ID NO: 6413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannggtcttcanntttttttttttttttttttttttttttttt

SEQ ID NO: 6414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannaggttcagnntttttttttttttttttttttttttttttt

SEQ ID NO: 6415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannctagagcanntttttttttttttttttttttttttttttt

SEQ ID NO: 6416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncttctagcnntttttttttttttttttttttttttttttt

SEQ ID NO: 6417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngagtaacgnntttttttttttttttttttttttttttttt

SEQ ID NO: 6418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannctaagaggnntttttttttttttttttttttttttttttt

SEQ ID NO: 6419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannacgtgtagnntttttttttttttttttttttttttttttt

SEQ ID NO: 6420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannactacaggnntttttttttttttttttttttttttttttt

SEQ ID NO: 6421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntacaggtcnntttttttttttttttttttttttttttttt

SEQ ID NO: 6422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannctcacatgnntttttttttttttttttttttttttttttt

SEQ ID NO: 6423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannactaggagnntttttttttttttttttttttttttttttt

SEQ ID NO: 6424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannccatagganntttttttttttttttttttttttttttttt

SEQ ID NO: 6425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannggagaatcnntttttttttttttttttttttttttttttt

SEQ ID NO: 6426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngccaagaanntttttttttttttttttttttttttttttt

SEQ ID NO: 6427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannaaggcaagnntttttttttttttttttttttttttttttt

SEQ ID NO: 6428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannaatgtcgcnntttttttttttttttttttttttttttttt

SEQ ID NO: 6429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannatggaaccnntttttttttttttttttttttttttttttt

SEQ ID NO: 6430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannagaggcatnntttttttttttttttttttttttttttttt

SEQ ID NO: 6431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntgcatagcnntttttttttttttttttttttttttttttt

SEQ ID NO: 6432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannctaacgganntttttttttttttttttttttttttttttt

SEQ ID NO: 6433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntatcgaggnntttttttttttttttttttttttttttttt

SEQ ID NO: 6434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncatagcctnntttttttttttttttttttttttttttttt

SEQ ID NO: 6435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannatcgagacnntttttttttttttttttttttttttttttt

SEQ ID NO: 6436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannggaagagtnntttttttttttttttttttttttttttttt

SEQ ID NO: 6437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannccaagtagnntttttttttttttttttttttttttttttt

SEQ ID NO: 6438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannctgaacagnntttttttttttttttttttttttttttttt

SEQ ID NO: 6439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngtaggttcnntttttttttttttttttttttttttttttt

SEQ ID NO: 6440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngtatggacnntttttttttttttttttttttttttttttt

SEQ ID NO: 6441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntcgcaacanntttttttttttttttttttttttttttttt

SEQ ID NO: 6442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannccgctaatnntttttttttttttttttttttttttttttt

SEQ ID NO: 6443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngattcgcanntttttttttttttttttttttttttttttt

SEQ ID NO: 6444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncgatggaanntttttttttttttttttttttttttttttt

SEQ ID NO: 6445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannagcaagganntttttttttttttttttttttttttttttt

SEQ ID NO: 6446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncgtagcaanntttttttttttttttttttttttttttttt

SEQ ID NO: 6447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntggcagtanntttttttttttttttttttttttttttttt

SEQ ID NO: 6448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncggtagttnntttttttttttttttttttttttttttttt

SEQ ID NO: 6449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntgacttcgnntttttttttttttttttttttttttttttt

SEQ ID NO: 6450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngagtgcaanntttttttttttttttttttttttttttttt

SEQ ID NO: 6451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannacggtaacnntttttttttttttttttttttttttttttt

SEQ ID NO: 6452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannaagtggtgnntttttttttttttttttttttttttttttt

SEQ ID NO: 6453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannggagacaanntttttttttttttttttttttttttttttt

SEQ ID NO: 6454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntcaaggacnntttttttttttttttttttttttttttttt

SEQ ID NO: 6455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannaagagagcnntttttttttttttttttttttttttttttt

SEQ ID NO: 6456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncgagagatnntttttttttttttttttttttttttttttt

SEQ ID NO: 6457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannacagatggnntttttttttttttttttttttttttttttt

SEQ ID NO: 6458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannaggagtcanntttttttttttttttttttttttttttttt

SEQ ID NO: 6459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncgtgttacnntttttttttttttttttttttttttttttt

SEQ ID NO: 6460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntagtgtgcnntttttttttttttttttttttttttttttt

SEQ ID NO: 6461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannctcatgacnntttttttttttttttttttttttttttttt

SEQ ID NO: 6462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngtatccagnntttttttttttttttttttttttttttttt

SEQ ID NO: 6463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannacgcctatnntttttttttttttttttttttttttttttt

SEQ ID NO: 6464 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannaacgacctnntttttttttttttttttttttttttttttt

SEQ ID NO: 6465 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannatcaggctnntttttttttttttttttttttttttttttt

SEQ ID NO: 6466 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncaagttcgnntttttttttttttttttttttttttttttt

SEQ ID NO: 6467 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntagccaganntttttttttttttttttttttttttttttt

SEQ ID NO: 6468 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncaatcacgnntttttttttttttttttttttttttttttt

SEQ ID NO: 6469 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanngcaacaagnntttttttttttttttttttttttttttttt

SEQ ID NO: 6470 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncacgacaanntttttttttttttttttttttttttttttt

SEQ ID NO: 6471 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntacggaganntttttttttttttttttttttttttttttt

SEQ ID NO: 6472 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncgacaaganntttttttttttttttttttttttttttttt

SEQ ID NO: 6473 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncgaagtganntttttttttttttttttttttttttttttt

SEQ ID NO: 6474 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannagctggtanntttttttttttttttttttttttttttttt

SEQ ID NO: 6475 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannaactaggcnntttttttttttttttttttttttttttttt

SEQ ID NO: 6476 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncagcaagtnntttttttttttttttttttttttttttttt

SEQ ID NO: 6477 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannacgaggtanntttttttttttttttttttttttttttttt

SEQ ID NO: 6478 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncatcttccnntttttttttttttttttttttttttttttt

SEQ ID NO: 6479 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncctgaatcnntttttttttttttttttttttttttttttt

SEQ ID NO: 6480 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanntgcagactnntttttttttttttttttttttttttttttt

SEQ ID NO: 6481 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannagatgtggnntttttttttttttttttttttttttttttt

SEQ ID NO: 6482 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannagttcgacnntttttttttttttttttttttttttttttt

SEQ ID NO: 6483 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaannacaacctcnntttttttttttttttttttttttttttttt

SEQ ID NO: 6484 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncatggtagnntttttttttttttttttttttttttttttt

SEQ ID NO: 6485 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncgtatctcnntttttttttttttttttttttttttttttt

SEQ ID NO: 6486 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncctagttcnntttttttttttttttttttttttttttttt

SEQ ID NO: 6487 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaggagaanncaagagtcnntttttttttttttttttttttttttttttt

SEQ ID NO: 6488 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnaatcggcanntttttttttttttttttttttttttttttt

SEQ ID NO: 6489 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntacggcatnntttttttttttttttttttttttttttttt

SEQ ID NO: 6490 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnttggatcgnntttttttttttttttttttttttttttttt

SEQ ID NO: 6491 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntggaacganntttttttttttttttttttttttttttttt

SEQ ID NO: 6492 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnggcaatcanntttttttttttttttttttttttttttttt

SEQ ID NO: 6493 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngaatccganntttttttttttttttttttttttttttttt

SEQ ID NO: 6494 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnttacggtgnntttttttttttttttttttttttttttttt

SEQ ID NO: 6495 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncatatcggnntttttttttttttttttttttttttttttt

SEQ ID NO: 6496 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncttcggtanntttttttttttttttttttttttttttttt

SEQ ID NO: 6497 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntcctaacgnntttttttttttttttttttttttttttttt

SEQ ID NO: 6498 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngtaagccanntttttttttttttttttttttttttttttt

SEQ ID NO: 6499 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntaaggtggnntttttttttttttttttttttttttttttt

SEQ ID NO: 6500 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnggtaagctnntttttttttttttttttttttttttttttt

SEQ ID NO: 6501 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntgtgtcganntttttttttttttttttttttttttttttt

SEQ ID NO: 6502 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngagcatganntttttttttttttttttttttttttttttt

SEQ ID NO: 6503 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntcgaagtcnntttttttttttttttttttttttttttttt

SEQ ID NO: 6504 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnggtgaacanntttttttttttttttttttttttttttttt

SEQ ID NO: 6505 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnacatgcacnntttttttttttttttttttttttttttttt

SEQ ID NO: 6506 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnccaacagtnntttttttttttttttttttttttttttttt

SEQ ID NO: 6507 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnagaacagcnntttttttttttttttttttttttttttttt

SEQ ID NO: 6508 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngaacacgtnntttttttttttttttttttttttttttttt

SEQ ID NO: 6509 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnggtcttcanntttttttttttttttttttttttttttttt

SEQ ID NO: 6510 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnaggttcagnntttttttttttttttttttttttttttttt

SEQ ID NO: 6511 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnctagagcanntttttttttttttttttttttttttttttt

SEQ ID NO: 6512 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncttctagcnntttttttttttttttttttttttttttttt

SEQ ID NO: 6513 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngagtaacgnntttttttttttttttttttttttttttttt

SEQ ID NO: 6514 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnctaagaggnntttttttttttttttttttttttttttttt

SEQ ID NO: 6515 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnacgtgtagnntttttttttttttttttttttttttttttt

SEQ ID NO: 6516 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnactacaggnntttttttttttttttttttttttttttttt

SEQ ID NO: 6517 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntacaggtcnntttttttttttttttttttttttttttttt

SEQ ID NO: 6518 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnctcacatgnntttttttttttttttttttttttttttttt

SEQ ID NO: 6519 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnactaggagnntttttttttttttttttttttttttttttt

SEQ ID NO: 6520 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnccatagganntttttttttttttttttttttttttttttt

SEQ ID NO: 6521 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnggagaatcnntttttttttttttttttttttttttttttt

SEQ ID NO: 6522 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngccaagaanntttttttttttttttttttttttttttttt

SEQ ID NO: 6523 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnaaggcaagnntttttttttttttttttttttttttttttt

SEQ ID NO: 6524 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnaatgtcgcnntttttttttttttttttttttttttttttt

SEQ ID NO: 6525 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnatggaaccnntttttttttttttttttttttttttttttt

SEQ ID NO: 6526 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnagaggcatnntttttttttttttttttttttttttttttt

SEQ ID NO: 6527 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntgcatagcnntttttttttttttttttttttttttttttt

SEQ ID NO: 6528 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnctaacgganntttttttttttttttttttttttttttttt

SEQ ID NO: 6529 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntatcgaggnntttttttttttttttttttttttttttttt

SEQ ID NO: 6530 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncatagcctnntttttttttttttttttttttttttttttt

SEQ ID NO: 6531 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnatcgagacnntttttttttttttttttttttttttttttt

SEQ ID NO: 6532 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnggaagagtnntttttttttttttttttttttttttttttt

SEQ ID NO: 6533 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnccaagtagnntttttttttttttttttttttttttttttt

SEQ ID NO: 6534 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnctgaacagnntttttttttttttttttttttttttttttt

SEQ ID NO: 6535 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngtaggttcnntttttttttttttttttttttttttttttt

SEQ ID NO: 6536 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngtatggacnntttttttttttttttttttttttttttttt

SEQ ID NO: 6537 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntcgcaacanntttttttttttttttttttttttttttttt

SEQ ID NO: 6538 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnccgctaatnntttttttttttttttttttttttttttttt

SEQ ID NO: 6539 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngattcgcanntttttttttttttttttttttttttttttt

SEQ ID NO: 6540 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncgatggaanntttttttttttttttttttttttttttttt

SEQ ID NO: 6541 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnagcaagganntttttttttttttttttttttttttttttt

SEQ ID NO: 6542 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncgtagcaanntttttttttttttttttttttttttttttt

SEQ ID NO: 6543 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntggcagtanntttttttttttttttttttttttttttttt

SEQ ID NO: 6544 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncggtagttnntttttttttttttttttttttttttttttt

SEQ ID NO: 6545 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntgacttcgnntttttttttttttttttttttttttttttt

SEQ ID NO: 6546 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngagtgcaanntttttttttttttttttttttttttttttt

SEQ ID NO: 6547 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnacggtaacnntttttttttttttttttttttttttttttt

SEQ ID NO: 6548 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnaagtggtgnntttttttttttttttttttttttttttttt

SEQ ID NO: 6549 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnggagacaanntttttttttttttttttttttttttttttt

SEQ ID NO: 6550 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntcaaggacnntttttttttttttttttttttttttttttt

SEQ ID NO: 6551 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnaagagagcnntttttttttttttttttttttttttttttt

SEQ ID NO: 6552 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncgagagatnntttttttttttttttttttttttttttttt

SEQ ID NO: 6553 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnacagatggnntttttttttttttttttttttttttttttt

SEQ ID NO: 6554 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnaggagtcanntttttttttttttttttttttttttttttt

SEQ ID NO: 6555 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncgtgttacnntttttttttttttttttttttttttttttt

SEQ ID NO: 6556 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntagtgtgcnntttttttttttttttttttttttttttttt

SEQ ID NO: 6557 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnctcatgacnntttttttttttttttttttttttttttttt

SEQ ID NO: 6558 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngtatccagnntttttttttttttttttttttttttttttt

SEQ ID NO: 6559 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnacgcctatnntttttttttttttttttttttttttttttt

SEQ ID NO: 6560 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnaacgacctnntttttttttttttttttttttttttttttt

SEQ ID NO: 6561 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnatcaggctnntttttttttttttttttttttttttttttt

SEQ ID NO: 6562 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncaagttcgnntttttttttttttttttttttttttttttt

SEQ ID NO: 6563 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntagccaganntttttttttttttttttttttttttttttt

SEQ ID NO: 6564 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncaatcacgnntttttttttttttttttttttttttttttt

SEQ ID NO: 6565 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnngcaacaagnntttttttttttttttttttttttttttttt

SEQ ID NO: 6566 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncacgacaanntttttttttttttttttttttttttttttt

SEQ ID NO: 6567 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntacggaganntttttttttttttttttttttttttttttt

SEQ ID NO: 6568 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncgacaaganntttttttttttttttttttttttttttttt

SEQ ID NO: 6569 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncgaagtganntttttttttttttttttttttttttttttt

SEQ ID NO: 6570 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnagctggtanntttttttttttttttttttttttttttttt

SEQ ID NO: 6571 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnaactaggcnntttttttttttttttttttttttttttttt

SEQ ID NO: 6572 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncagcaagtnntttttttttttttttttttttttttttttt

SEQ ID NO: 6573 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnacgaggtanntttttttttttttttttttttttttttttt

SEQ ID NO: 6574 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncatcttccnntttttttttttttttttttttttttttttt

SEQ ID NO: 6575 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncctgaatcnntttttttttttttttttttttttttttttt

SEQ ID NO: 6576 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnntgcagactnntttttttttttttttttttttttttttttt

SEQ ID NO: 6577 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnagatgtggnntttttttttttttttttttttttttttttt

SEQ ID NO: 6578 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnagttcgacnntttttttttttttttttttttttttttttt

SEQ ID NO: 6579 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnnacaacctcnntttttttttttttttttttttttttttttt

SEQ ID NO: 6580 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncatggtagnntttttttttttttttttttttttttttttt

SEQ ID NO: 6581 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncgtatctcnntttttttttttttttttttttttttttttt

SEQ ID NO: 6582 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncctagttcnntttttttttttttttttttttttttttttt

SEQ ID NO: 6583 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatggtnncaagagtcnntttttttttttttttttttttttttttttt

SEQ ID NO: 6584 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnaatcggcanntttttttttttttttttttttttttttttt

SEQ ID NO: 6585 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntacggcatnntttttttttttttttttttttttttttttt

SEQ ID NO: 6586 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnttggatcgnntttttttttttttttttttttttttttttt

SEQ ID NO: 6587 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntggaacganntttttttttttttttttttttttttttttt

SEQ ID NO: 6588 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnggcaatcanntttttttttttttttttttttttttttttt

SEQ ID NO: 6589 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngaatccganntttttttttttttttttttttttttttttt

SEQ ID NO: 6590 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnttacggtgnntttttttttttttttttttttttttttttt

SEQ ID NO: 6591 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncatatcggnntttttttttttttttttttttttttttttt

SEQ ID NO: 6592 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncttcggtanntttttttttttttttttttttttttttttt

SEQ ID NO: 6593 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntcctaacgnntttttttttttttttttttttttttttttt

SEQ ID NO: 6594 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngtaagccanntttttttttttttttttttttttttttttt

SEQ ID NO: 6595 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntaaggtggnntttttttttttttttttttttttttttttt

SEQ ID NO: 6596 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnggtaagctnntttttttttttttttttttttttttttttt

SEQ ID NO: 6597 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntgtgtcganntttttttttttttttttttttttttttttt

SEQ ID NO: 6598 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngagcatganntttttttttttttttttttttttttttttt

SEQ ID NO: 6599 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntcgaagtcnntttttttttttttttttttttttttttttt

SEQ ID NO: 6600 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnggtgaacanntttttttttttttttttttttttttttttt

SEQ ID NO: 6601 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnacatgcacnntttttttttttttttttttttttttttttt

SEQ ID NO: 6602 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnccaacagtnntttttttttttttttttttttttttttttt

SEQ ID NO: 6603 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnagaacagcnntttttttttttttttttttttttttttttt

SEQ ID NO: 6604 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngaacacgtnntttttttttttttttttttttttttttttt

SEQ ID NO: 6605 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnggtcttcanntttttttttttttttttttttttttttttt

SEQ ID NO: 6606 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnaggttcagnntttttttttttttttttttttttttttttt

SEQ ID NO: 6607 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnctagagcanntttttttttttttttttttttttttttttt

SEQ ID NO: 6608 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncttctagcnntttttttttttttttttttttttttttttt

SEQ ID NO: 6609 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngagtaacgnntttttttttttttttttttttttttttttt

SEQ ID NO: 6610 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnctaagaggnntttttttttttttttttttttttttttttt

SEQ ID NO: 6611 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnacgtgtagnntttttttttttttttttttttttttttttt

SEQ ID NO: 6612 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnactacaggnntttttttttttttttttttttttttttttt

SEQ ID NO: 6613 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntacaggtcnntttttttttttttttttttttttttttttt

SEQ ID NO: 6614 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnctcacatgnntttttttttttttttttttttttttttttt

SEQ ID NO: 6615 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnactaggagnntttttttttttttttttttttttttttttt

SEQ ID NO: 6616 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnccatagganntttttttttttttttttttttttttttttt

SEQ ID NO: 6617 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnggagaatcnntttttttttttttttttttttttttttttt

SEQ ID NO: 6618 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngccaagaanntttttttttttttttttttttttttttttt

SEQ ID NO: 6619 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnaaggcaagnntttttttttttttttttttttttttttttt

SEQ ID NO: 6620 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnaatgtcgcnntttttttttttttttttttttttttttttt

SEQ ID NO: 6621 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnatggaaccnntttttttttttttttttttttttttttttt

SEQ ID NO: 6622 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnagaggcatnntttttttttttttttttttttttttttttt

SEQ ID NO: 6623 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntgcatagcnntttttttttttttttttttttttttttttt

SEQ ID NO: 6624 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnctaacgganntttttttttttttttttttttttttttttt

SEQ ID NO: 6625 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntatcgaggnntttttttttttttttttttttttttttttt

SEQ ID NO: 6626 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncatagcctnntttttttttttttttttttttttttttttt

SEQ ID NO: 6627 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnatcgagacnntttttttttttttttttttttttttttttt

SEQ ID NO: 6628 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnggaagagtnntttttttttttttttttttttttttttttt

SEQ ID NO: 6629 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnccaagtagnntttttttttttttttttttttttttttttt

SEQ ID NO: 6630 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnctgaacagnntttttttttttttttttttttttttttttt

SEQ ID NO: 6631 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngtaggttcnntttttttttttttttttttttttttttttt

SEQ ID NO: 6632 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngtatggacnntttttttttttttttttttttttttttttt

SEQ ID NO: 6633 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntcgcaacanntttttttttttttttttttttttttttttt

SEQ ID NO: 6634 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnccgctaatnntttttttttttttttttttttttttttttt

SEQ ID NO: 6635 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngattcgcanntttttttttttttttttttttttttttttt

SEQ ID NO: 6636 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncgatggaanntttttttttttttttttttttttttttttt

SEQ ID NO: 6637 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnagcaagganntttttttttttttttttttttttttttttt

SEQ ID NO: 6638 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncgtagcaanntttttttttttttttttttttttttttttt

SEQ ID NO: 6639 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntggcagtanntttttttttttttttttttttttttttttt

SEQ ID NO: 6640 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncggtagttnntttttttttttttttttttttttttttttt

SEQ ID NO: 6641 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntgacttcgnntttttttttttttttttttttttttttttt

SEQ ID NO: 6642 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngagtgcaanntttttttttttttttttttttttttttttt

SEQ ID NO: 6643 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnacggtaacnntttttttttttttttttttttttttttttt

SEQ ID NO: 6644 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnaagtggtgnntttttttttttttttttttttttttttttt

SEQ ID NO: 6645 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnggagacaanntttttttttttttttttttttttttttttt

SEQ ID NO: 6646 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntcaaggacnntttttttttttttttttttttttttttttt

SEQ ID NO: 6647 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnaagagagcnntttttttttttttttttttttttttttttt

SEQ ID NO: 6648 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncgagagatnntttttttttttttttttttttttttttttt

SEQ ID NO: 6649 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnacagatggnntttttttttttttttttttttttttttttt

SEQ ID NO: 6650 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnaggagtcanntttttttttttttttttttttttttttttt

SEQ ID NO: 6651 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncgtgttacnntttttttttttttttttttttttttttttt

SEQ ID NO: 6652 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntagtgtgcnntttttttttttttttttttttttttttttt

SEQ ID NO: 6653 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnctcatgacnntttttttttttttttttttttttttttttt

SEQ ID NO: 6654 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngtatccagnntttttttttttttttttttttttttttttt

SEQ ID NO: 6655 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnacgcctatnntttttttttttttttttttttttttttttt

SEQ ID NO: 6656 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnaacgacctnntttttttttttttttttttttttttttttt

SEQ ID NO: 6657 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnatcaggctnntttttttttttttttttttttttttttttt

SEQ ID NO: 6658 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncaagttcgnntttttttttttttttttttttttttttttt

SEQ ID NO: 6659 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntagccaganntttttttttttttttttttttttttttttt

SEQ ID NO: 6660 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncaatcacgnntttttttttttttttttttttttttttttt

SEQ ID NO: 6661 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnngcaacaagnntttttttttttttttttttttttttttttt

SEQ ID NO: 6662 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncacgacaanntttttttttttttttttttttttttttttt

SEQ ID NO: 6663 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntacggaganntttttttttttttttttttttttttttttt

SEQ ID NO: 6664 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncgacaaganntttttttttttttttttttttttttttttt

SEQ ID NO: 6665 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncgaagtganntttttttttttttttttttttttttttttt

SEQ ID NO: 6666 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnagctggtanntttttttttttttttttttttttttttttt

SEQ ID NO: 6667 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnaactaggcnntttttttttttttttttttttttttttttt

SEQ ID NO: 6668 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncagcaagtnntttttttttttttttttttttttttttttt

SEQ ID NO: 6669 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnacgaggtanntttttttttttttttttttttttttttttt

SEQ ID NO: 6670 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncatcttccnntttttttttttttttttttttttttttttt

SEQ ID NO: 6671 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncctgaatcnntttttttttttttttttttttttttttttt

SEQ ID NO: 6672 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnntgcagactnntttttttttttttttttttttttttttttt

SEQ ID NO: 6673 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnagatgtggnntttttttttttttttttttttttttttttt

SEQ ID NO: 6674 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnagttcgacnntttttttttttttttttttttttttttttt

SEQ ID NO: 6675 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnnacaacctcnntttttttttttttttttttttttttttttt

SEQ ID NO: 6676 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncatggtagnntttttttttttttttttttttttttttttt

SEQ ID NO: 6677 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncgtatctcnntttttttttttttttttttttttttttttt

SEQ ID NO: 6678 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncctagttcnntttttttttttttttttttttttttttttt

SEQ ID NO: 6679 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagtaggnncaagagtcnntttttttttttttttttttttttttttttt

SEQ ID NO: 6680 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnaatcggcanntttttttttttttttttttttttttttttt

SEQ ID NO: 6681 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntacggcatnntttttttttttttttttttttttttttttt

SEQ ID NO: 6682 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnttggatcgnntttttttttttttttttttttttttttttt

SEQ ID NO: 6683 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntggaacganntttttttttttttttttttttttttttttt

SEQ ID NO: 6684 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnggcaatcanntttttttttttttttttttttttttttttt

SEQ ID NO: 6685 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngaatccganntttttttttttttttttttttttttttttt

SEQ ID NO: 6686 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnttacggtgnntttttttttttttttttttttttttttttt

SEQ ID NO: 6687 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncatatcggnntttttttttttttttttttttttttttttt

SEQ ID NO: 6688 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncttcggtanntttttttttttttttttttttttttttttt

SEQ ID NO: 6689 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntcctaacgnntttttttttttttttttttttttttttttt

SEQ ID NO: 6690 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngtaagccanntttttttttttttttttttttttttttttt

SEQ ID NO: 6691 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntaaggtggnntttttttttttttttttttttttttttttt

SEQ ID NO: 6692 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnggtaagctnntttttttttttttttttttttttttttttt

SEQ ID NO: 6693 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntgtgtcganntttttttttttttttttttttttttttttt

SEQ ID NO: 6694 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngagcatganntttttttttttttttttttttttttttttt

SEQ ID NO: 6695 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntcgaagtcnntttttttttttttttttttttttttttttt

SEQ ID NO: 6696 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnggtgaacanntttttttttttttttttttttttttttttt

SEQ ID NO: 6697 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnacatgcacnntttttttttttttttttttttttttttttt

SEQ ID NO: 6698 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnccaacagtnntttttttttttttttttttttttttttttt

SEQ ID NO: 6699 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnagaacagcnntttttttttttttttttttttttttttttt

SEQ ID NO: 6700 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngaacacgtnntttttttttttttttttttttttttttttt

SEQ ID NO: 6701 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnggtcttcanntttttttttttttttttttttttttttttt

SEQ ID NO: 6702 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnaggttcagnntttttttttttttttttttttttttttttt

SEQ ID NO: 6703 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnctagagcanntttttttttttttttttttttttttttttt

SEQ ID NO: 6704 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncttctagcnntttttttttttttttttttttttttttttt

SEQ ID NO: 6705 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngagtaacgnntttttttttttttttttttttttttttttt

SEQ ID NO: 6706 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnctaagaggnntttttttttttttttttttttttttttttt

SEQ ID NO: 6707 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnacgtgtagnntttttttttttttttttttttttttttttt

SEQ ID NO: 6708 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnactacaggnntttttttttttttttttttttttttttttt

SEQ ID NO: 6709 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntacaggtcnntttttttttttttttttttttttttttttt

SEQ ID NO: 6710 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnctcacatgnntttttttttttttttttttttttttttttt

SEQ ID NO: 6711 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnactaggagnntttttttttttttttttttttttttttttt

SEQ ID NO: 6712 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnccatagganntttttttttttttttttttttttttttttt

SEQ ID NO: 6713 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnggagaatcnntttttttttttttttttttttttttttttt

SEQ ID NO: 6714 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngccaagaanntttttttttttttttttttttttttttttt

SEQ ID NO: 6715 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnaaggcaagnntttttttttttttttttttttttttttttt

SEQ ID NO: 6716 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnaatgtcgcnntttttttttttttttttttttttttttttt

SEQ ID NO: 6717 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnatggaaccnntttttttttttttttttttttttttttttt

SEQ ID NO: 6718 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnagaggcatnntttttttttttttttttttttttttttttt

SEQ ID NO: 6719 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntgcatagcnntttttttttttttttttttttttttttttt

SEQ ID NO: 6720 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnctaacgganntttttttttttttttttttttttttttttt

SEQ ID NO: 6721 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntatcgaggnntttttttttttttttttttttttttttttt

SEQ ID NO: 6722 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncatagcctnntttttttttttttttttttttttttttttt

SEQ ID NO: 6723 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnatcgagacnntttttttttttttttttttttttttttttt

SEQ ID NO: 6724 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnggaagagtnntttttttttttttttttttttttttttttt

SEQ ID NO: 6725 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnccaagtagnntttttttttttttttttttttttttttttt

SEQ ID NO: 6726 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnctgaacagnntttttttttttttttttttttttttttttt

SEQ ID NO: 6727 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngtaggttcnntttttttttttttttttttttttttttttt

SEQ ID NO: 6728 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngtatggacnntttttttttttttttttttttttttttttt

SEQ ID NO: 6729 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntcgcaacanntttttttttttttttttttttttttttttt

SEQ ID NO: 6730 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnccgctaatnntttttttttttttttttttttttttttttt

SEQ ID NO: 6731 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngattcgcanntttttttttttttttttttttttttttttt

SEQ ID NO: 6732 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncgatggaanntttttttttttttttttttttttttttttt

SEQ ID NO: 6733 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnagcaagganntttttttttttttttttttttttttttttt

SEQ ID NO: 6734 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncgtagcaanntttttttttttttttttttttttttttttt

SEQ ID NO: 6735 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntggcagtanntttttttttttttttttttttttttttttt

SEQ ID NO: 6736 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncggtagttnntttttttttttttttttttttttttttttt

SEQ ID NO: 6737 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntgacttcgnntttttttttttttttttttttttttttttt

SEQ ID NO: 6738 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngagtgcaanntttttttttttttttttttttttttttttt

SEQ ID NO: 6739 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnacggtaacnntttttttttttttttttttttttttttttt

SEQ ID NO: 6740 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnaagtggtgnntttttttttttttttttttttttttttttt

SEQ ID NO: 6741 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnggagacaanntttttttttttttttttttttttttttttt

SEQ ID NO: 6742 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntcaaggacnntttttttttttttttttttttttttttttt

SEQ ID NO: 6743 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnaagagagcnntttttttttttttttttttttttttttttt

SEQ ID NO: 6744 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncgagagatnntttttttttttttttttttttttttttttt

SEQ ID NO: 6745 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnacagatggnntttttttttttttttttttttttttttttt

SEQ ID NO: 6746 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnaggagtcanntttttttttttttttttttttttttttttt

SEQ ID NO: 6747 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncgtgttacnntttttttttttttttttttttttttttttt

SEQ ID NO: 6748 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntagtgtgcnntttttttttttttttttttttttttttttt

SEQ ID NO: 6749 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnctcatgacnntttttttttttttttttttttttttttttt

SEQ ID NO: 6750 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngtatccagnntttttttttttttttttttttttttttttt

SEQ ID NO: 6751 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnacgcctatnntttttttttttttttttttttttttttttt

SEQ ID NO: 6752 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnaacgacctnntttttttttttttttttttttttttttttt

SEQ ID NO: 6753 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnatcaggctnntttttttttttttttttttttttttttttt

SEQ ID NO: 6754 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncaagttcgnntttttttttttttttttttttttttttttt

SEQ ID NO: 6755 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntagccaganntttttttttttttttttttttttttttttt

SEQ ID NO: 6756 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncaatcacgnntttttttttttttttttttttttttttttt

SEQ ID NO: 6757 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnngcaacaagnntttttttttttttttttttttttttttttt

SEQ ID NO: 6758 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncacgacaanntttttttttttttttttttttttttttttt

SEQ ID NO: 6759 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntacggaganntttttttttttttttttttttttttttttt

SEQ ID NO: 6760 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncgacaaganntttttttttttttttttttttttttttttt

SEQ ID NO: 6761 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncgaagtganntttttttttttttttttttttttttttttt

SEQ ID NO: 6762 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnagctggtanntttttttttttttttttttttttttttttt

SEQ ID NO: 6763 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnaactaggcnntttttttttttttttttttttttttttttt

SEQ ID NO: 6764 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncagcaagtnntttttttttttttttttttttttttttttt

SEQ ID NO: 6765 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnacgaggtanntttttttttttttttttttttttttttttt

SEQ ID NO: 6766 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncatcttccnntttttttttttttttttttttttttttttt

SEQ ID NO: 6767 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncctgaatcnntttttttttttttttttttttttttttttt

SEQ ID NO: 6768 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnntgcagactnntttttttttttttttttttttttttttttt

SEQ ID NO: 6769 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnagatgtggnntttttttttttttttttttttttttttttt

SEQ ID NO: 6770 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnagttcgacnntttttttttttttttttttttttttttttt

SEQ ID NO: 6771 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnnacaacctcnntttttttttttttttttttttttttttttt

SEQ ID NO: 6772 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncatggtagnntttttttttttttttttttttttttttttt

SEQ ID NO: 6773 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncgtatctcnntttttttttttttttttttttttttttttt

SEQ ID NO: 6774 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncctagttcnntttttttttttttttttttttttttttttt

SEQ ID NO: 6775 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggcatatnncaagagtcnntttttttttttttttttttttttttttttt

SEQ ID NO: 6776 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannaatcggcanntttttttttttttttttttttttttttttt

SEQ ID NO: 6777 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntacggcatnntttttttttttttttttttttttttttttt

SEQ ID NO: 6778 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannttggatcgnntttttttttttttttttttttttttttttt

SEQ ID NO: 6779 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntggaacganntttttttttttttttttttttttttttttt

SEQ ID NO: 6780 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannggcaatcanntttttttttttttttttttttttttttttt

SEQ ID NO: 6781 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngaatccganntttttttttttttttttttttttttttttt

SEQ ID NO: 6782 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannttacggtgnntttttttttttttttttttttttttttttt

SEQ ID NO: 6783 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncatatcggnntttttttttttttttttttttttttttttt

SEQ ID NO: 6784 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncttcggtanntttttttttttttttttttttttttttttt

SEQ ID NO: 6785 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntcctaacgnntttttttttttttttttttttttttttttt

SEQ ID NO: 6786 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngtaagccanntttttttttttttttttttttttttttttt

SEQ ID NO: 6787 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntaaggtggnntttttttttttttttttttttttttttttt

SEQ ID NO: 6788 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannggtaagctnntttttttttttttttttttttttttttttt

SEQ ID NO: 6789 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntgtgtcganntttttttttttttttttttttttttttttt

SEQ ID NO: 6790 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngagcatganntttttttttttttttttttttttttttttt

SEQ ID NO: 6791 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntcgaagtcnntttttttttttttttttttttttttttttt

SEQ ID NO: 6792 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannggtgaacanntttttttttttttttttttttttttttttt

SEQ ID NO: 6793 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannacatgcacnntttttttttttttttttttttttttttttt

SEQ ID NO: 6794 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannccaacagtnntttttttttttttttttttttttttttttt

SEQ ID NO: 6795 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannagaacagcnntttttttttttttttttttttttttttttt

SEQ ID NO: 6796 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngaacacgtnntttttttttttttttttttttttttttttt

SEQ ID NO: 6797 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannggtcttcanntttttttttttttttttttttttttttttt

SEQ ID NO: 6798 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannaggttcagnntttttttttttttttttttttttttttttt

SEQ ID NO: 6799 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannctagagcanntttttttttttttttttttttttttttttt

SEQ ID NO: 6800 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncttctagcnntttttttttttttttttttttttttttttt

SEQ ID NO: 6801 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngagtaacgnntttttttttttttttttttttttttttttt

SEQ ID NO: 6802 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannctaagaggnntttttttttttttttttttttttttttttt

SEQ ID NO: 6803 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannacgtgtagnntttttttttttttttttttttttttttttt

SEQ ID NO: 6804 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannactacaggnntttttttttttttttttttttttttttttt

SEQ ID NO: 6805 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntacaggtcnntttttttttttttttttttttttttttttt

SEQ ID NO: 6806 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannctcacatgnntttttttttttttttttttttttttttttt

SEQ ID NO: 6807 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannactaggagnntttttttttttttttttttttttttttttt

SEQ ID NO: 6808 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannccatagganntttttttttttttttttttttttttttttt

SEQ ID NO: 6809 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannggagaatcnntttttttttttttttttttttttttttttt

SEQ ID NO: 6810 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngccaagaanntttttttttttttttttttttttttttttt

SEQ ID NO: 6811 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannaaggcaagnntttttttttttttttttttttttttttttt

SEQ ID NO: 6812 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannaatgtcgcnntttttttttttttttttttttttttttttt

SEQ ID NO: 6813 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannatggaaccnntttttttttttttttttttttttttttttt

SEQ ID NO: 6814 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannagaggcatnntttttttttttttttttttttttttttttt

SEQ ID NO: 6815 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntgcatagcnntttttttttttttttttttttttttttttt

SEQ ID NO: 6816 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannctaacgganntttttttttttttttttttttttttttttt

SEQ ID NO: 6817 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntatcgaggnntttttttttttttttttttttttttttttt

SEQ ID NO: 6818 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncatagcctnntttttttttttttttttttttttttttttt

SEQ ID NO: 6819 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannatcgagacnntttttttttttttttttttttttttttttt

SEQ ID NO: 6820 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannggaagagtnntttttttttttttttttttttttttttttt

SEQ ID NO: 6821 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannccaagtagnntttttttttttttttttttttttttttttt

SEQ ID NO: 6822 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannctgaacagnntttttttttttttttttttttttttttttt

SEQ ID NO: 6823 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngtaggttcnntttttttttttttttttttttttttttttt

SEQ ID NO: 6824 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngtatggacnntttttttttttttttttttttttttttttt

SEQ ID NO: 6825 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntcgcaacanntttttttttttttttttttttttttttttt

SEQ ID NO: 6826 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannccgctaatnntttttttttttttttttttttttttttttt

SEQ ID NO: 6827 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngattcgcanntttttttttttttttttttttttttttttt

SEQ ID NO: 6828 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncgatggaanntttttttttttttttttttttttttttttt

SEQ ID NO: 6829 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannagcaagganntttttttttttttttttttttttttttttt

SEQ ID NO: 6830 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncgtagcaanntttttttttttttttttttttttttttttt

SEQ ID NO: 6831 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntggcagtanntttttttttttttttttttttttttttttt

SEQ ID NO: 6832 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncggtagttnntttttttttttttttttttttttttttttt

SEQ ID NO: 6833 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntgacttcgnntttttttttttttttttttttttttttttt

SEQ ID NO: 6834 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngagtgcaanntttttttttttttttttttttttttttttt

SEQ ID NO: 6835 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannacggtaacnntttttttttttttttttttttttttttttt

SEQ ID NO: 6836 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannaagtggtgnntttttttttttttttttttttttttttttt

SEQ ID NO: 6837 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannggagacaanntttttttttttttttttttttttttttttt

SEQ ID NO: 6838 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntcaaggacnntttttttttttttttttttttttttttttt

SEQ ID NO: 6839 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannaagagagcnntttttttttttttttttttttttttttttt

SEQ ID NO: 6840 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncgagagatnntttttttttttttttttttttttttttttt

SEQ ID NO: 6841 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannacagatggnntttttttttttttttttttttttttttttt

SEQ ID NO: 6842 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannaggagtcanntttttttttttttttttttttttttttttt

SEQ ID NO: 6843 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncgtgttacnntttttttttttttttttttttttttttttt

SEQ ID NO: 6844 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntagtgtgcnntttttttttttttttttttttttttttttt

SEQ ID NO: 6845 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannctcatgacnntttttttttttttttttttttttttttttt

SEQ ID NO: 6846 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngtatccagnntttttttttttttttttttttttttttttt

SEQ ID NO: 6847 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannacgcctatnntttttttttttttttttttttttttttttt

SEQ ID NO: 6848 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannaacgacctnntttttttttttttttttttttttttttttt

SEQ ID NO: 6849 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannatcaggctnntttttttttttttttttttttttttttttt

SEQ ID NO: 6850 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncaagttcgnntttttttttttttttttttttttttttttt

SEQ ID NO: 6851 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntagccaganntttttttttttttttttttttttttttttt

SEQ ID NO: 6852 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncaatcacgnntttttttttttttttttttttttttttttt

SEQ ID NO: 6853 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanngcaacaagnntttttttttttttttttttttttttttttt

SEQ ID NO: 6854 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncacgacaanntttttttttttttttttttttttttttttt

SEQ ID NO: 6855 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntacggaganntttttttttttttttttttttttttttttt

SEQ ID NO: 6856 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncgacaaganntttttttttttttttttttttttttttttt

SEQ ID NO: 6857 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncgaagtganntttttttttttttttttttttttttttttt

SEQ ID NO: 6858 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannagctggtanntttttttttttttttttttttttttttttt

SEQ ID NO: 6859 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannaactaggcnntttttttttttttttttttttttttttttt

SEQ ID NO: 6860 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncagcaagtnntttttttttttttttttttttttttttttt

SEQ ID NO: 6861 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannacgaggtanntttttttttttttttttttttttttttttt

SEQ ID NO: 6862 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncatcttccnntttttttttttttttttttttttttttttt

SEQ ID NO: 6863 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncctgaatcnntttttttttttttttttttttttttttttt

SEQ ID NO: 6864 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanntgcagactnntttttttttttttttttttttttttttttt

SEQ ID NO: 6865 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannagatgtggnntttttttttttttttttttttttttttttt

SEQ ID NO: 6866 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannagttcgacnntttttttttttttttttttttttttttttt

SEQ ID NO: 6867 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaannacaacctcnntttttttttttttttttttttttttttttt

SEQ ID NO: 6868 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncatggtagnntttttttttttttttttttttttttttttt

SEQ ID NO: 6869 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncgtatctcnntttttttttttttttttttttttttttttt

SEQ ID NO: 6870 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncctagttcnntttttttttttttttttttttttttttttt

SEQ ID NO: 6871 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncggaagaanncaagagtcnntttttttttttttttttttttttttttttt

SEQ ID NO: 6872 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnaatcggcanntttttttttttttttttttttttttttttt

SEQ ID NO: 6873 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntacggcatnntttttttttttttttttttttttttttttt

SEQ ID NO: 6874 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnttggatcgnntttttttttttttttttttttttttttttt

SEQ ID NO: 6875 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntggaacganntttttttttttttttttttttttttttttt

SEQ ID NO: 6876 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnggcaatcanntttttttttttttttttttttttttttttt

SEQ ID NO: 6877 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngaatccganntttttttttttttttttttttttttttttt

SEQ ID NO: 6878 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnttacggtgnntttttttttttttttttttttttttttttt

SEQ ID NO: 6879 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncatatcggnntttttttttttttttttttttttttttttt

SEQ ID NO: 6880 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncttcggtanntttttttttttttttttttttttttttttt

SEQ ID NO: 6881 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntcctaacgnntttttttttttttttttttttttttttttt

SEQ ID NO: 6882 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngtaagccanntttttttttttttttttttttttttttttt

SEQ ID NO: 6883 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntaaggtggnntttttttttttttttttttttttttttttt

SEQ ID NO: 6884 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnggtaagctnntttttttttttttttttttttttttttttt

SEQ ID NO: 6885 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntgtgtcganntttttttttttttttttttttttttttttt

SEQ ID NO: 6886 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngagcatganntttttttttttttttttttttttttttttt

SEQ ID NO: 6887 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntcgaagtcnntttttttttttttttttttttttttttttt

SEQ ID NO: 6888 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnggtgaacanntttttttttttttttttttttttttttttt

SEQ ID NO: 6889 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnacatgcacnntttttttttttttttttttttttttttttt

SEQ ID NO: 6890 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnccaacagtnntttttttttttttttttttttttttttttt

SEQ ID NO: 6891 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnagaacagcnntttttttttttttttttttttttttttttt

SEQ ID NO: 6892 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngaacacgtnntttttttttttttttttttttttttttttt

SEQ ID NO: 6893 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnggtcttcanntttttttttttttttttttttttttttttt

SEQ ID NO: 6894 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnaggttcagnntttttttttttttttttttttttttttttt

SEQ ID NO: 6895 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnctagagcanntttttttttttttttttttttttttttttt

SEQ ID NO: 6896 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncttctagcnntttttttttttttttttttttttttttttt

SEQ ID NO: 6897 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngagtaacgnntttttttttttttttttttttttttttttt

SEQ ID NO: 6898 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnctaagaggnntttttttttttttttttttttttttttttt

SEQ ID NO: 6899 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnacgtgtagnntttttttttttttttttttttttttttttt

SEQ ID NO: 6900 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnactacaggnntttttttttttttttttttttttttttttt

SEQ ID NO: 6901 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntacaggtcnntttttttttttttttttttttttttttttt

SEQ ID NO: 6902 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnctcacatgnntttttttttttttttttttttttttttttt

SEQ ID NO: 6903 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnactaggagnntttttttttttttttttttttttttttttt

SEQ ID NO: 6904 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnccatagganntttttttttttttttttttttttttttttt

SEQ ID NO: 6905 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnggagaatcnntttttttttttttttttttttttttttttt

SEQ ID NO: 6906 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngccaagaanntttttttttttttttttttttttttttttt

SEQ ID NO: 6907 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnaaggcaagnntttttttttttttttttttttttttttttt

SEQ ID NO: 6908 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnaatgtcgcnntttttttttttttttttttttttttttttt

SEQ ID NO: 6909 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnatggaaccnntttttttttttttttttttttttttttttt

SEQ ID NO: 6910 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnagaggcatnntttttttttttttttttttttttttttttt

SEQ ID NO: 6911 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntgcatagcnntttttttttttttttttttttttttttttt

SEQ ID NO: 6912 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnctaacgganntttttttttttttttttttttttttttttt

SEQ ID NO: 6913 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntatcgaggnntttttttttttttttttttttttttttttt

SEQ ID NO: 6914 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncatagcctnntttttttttttttttttttttttttttttt

SEQ ID NO: 6915 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnatcgagacnntttttttttttttttttttttttttttttt

SEQ ID NO: 6916 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnggaagagtnntttttttttttttttttttttttttttttt

SEQ ID NO: 6917 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnccaagtagnntttttttttttttttttttttttttttttt

SEQ ID NO: 6918 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnctgaacagnntttttttttttttttttttttttttttttt

SEQ ID NO: 6919 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngtaggttcnntttttttttttttttttttttttttttttt

SEQ ID NO: 6920 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngtatggacnntttttttttttttttttttttttttttttt

SEQ ID NO: 6921 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntcgcaacanntttttttttttttttttttttttttttttt

SEQ ID NO: 6922 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnccgctaatnntttttttttttttttttttttttttttttt

SEQ ID NO: 6923 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngattcgcanntttttttttttttttttttttttttttttt

SEQ ID NO: 6924 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncgatggaanntttttttttttttttttttttttttttttt

SEQ ID NO: 6925 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnagcaagganntttttttttttttttttttttttttttttt

SEQ ID NO: 6926 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncgtagcaanntttttttttttttttttttttttttttttt

SEQ ID NO: 6927 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntggcagtanntttttttttttttttttttttttttttttt

SEQ ID NO: 6928 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncggtagttnntttttttttttttttttttttttttttttt

SEQ ID NO: 6929 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntgacttcgnntttttttttttttttttttttttttttttt

SEQ ID NO: 6930 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngagtgcaanntttttttttttttttttttttttttttttt

SEQ ID NO: 6931 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnacggtaacnntttttttttttttttttttttttttttttt

SEQ ID NO: 6932 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnaagtggtgnntttttttttttttttttttttttttttttt

SEQ ID NO: 6933 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnggagacaanntttttttttttttttttttttttttttttt

SEQ ID NO: 6934 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntcaaggacnntttttttttttttttttttttttttttttt

SEQ ID NO: 6935 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnaagagagcnntttttttttttttttttttttttttttttt

SEQ ID NO: 6936 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncgagagatnntttttttttttttttttttttttttttttt

SEQ ID NO: 6937 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnacagatggnntttttttttttttttttttttttttttttt

SEQ ID NO: 6938 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnaggagtcanntttttttttttttttttttttttttttttt

SEQ ID NO: 6939 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncgtgttacnntttttttttttttttttttttttttttttt

SEQ ID NO: 6940 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntagtgtgcnntttttttttttttttttttttttttttttt

SEQ ID NO: 6941 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnctcatgacnntttttttttttttttttttttttttttttt

SEQ ID NO: 6942 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngtatccagnntttttttttttttttttttttttttttttt

SEQ ID NO: 6943 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnacgcctatnntttttttttttttttttttttttttttttt

SEQ ID NO: 6944 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnaacgacctnntttttttttttttttttttttttttttttt

SEQ ID NO: 6945 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnatcaggctnntttttttttttttttttttttttttttttt

SEQ ID NO: 6946 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncaagttcgnntttttttttttttttttttttttttttttt

SEQ ID NO: 6947 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntagccaganntttttttttttttttttttttttttttttt

SEQ ID NO: 6948 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncaatcacgnntttttttttttttttttttttttttttttt

SEQ ID NO: 6949 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnngcaacaagnntttttttttttttttttttttttttttttt

SEQ ID NO: 6950 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncacgacaanntttttttttttttttttttttttttttttt

SEQ ID NO: 6951 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntacggaganntttttttttttttttttttttttttttttt

SEQ ID NO: 6952 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncgacaaganntttttttttttttttttttttttttttttt

SEQ ID NO: 6953 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncgaagtganntttttttttttttttttttttttttttttt

SEQ ID NO: 6954 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnagctggtanntttttttttttttttttttttttttttttt

SEQ ID NO: 6955 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnaactaggcnntttttttttttttttttttttttttttttt

SEQ ID NO: 6956 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncagcaagtnntttttttttttttttttttttttttttttt

SEQ ID NO: 6957 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnacgaggtanntttttttttttttttttttttttttttttt

SEQ ID NO: 6958 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncatcttccnntttttttttttttttttttttttttttttt

SEQ ID NO: 6959 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncctgaatcnntttttttttttttttttttttttttttttt

SEQ ID NO: 6960 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnntgcagactnntttttttttttttttttttttttttttttt

SEQ ID NO: 6961 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnagatgtggnntttttttttttttttttttttttttttttt

SEQ ID NO: 6962 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnagttcgacnntttttttttttttttttttttttttttttt

SEQ ID NO: 6963 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnnacaacctcnntttttttttttttttttttttttttttttt

SEQ ID NO: 6964 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncatggtagnntttttttttttttttttttttttttttttt

SEQ ID NO: 6965 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncgtatctcnntttttttttttttttttttttttttttttt

SEQ ID NO: 6966 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncctagttcnntttttttttttttttttttttttttttttt

SEQ ID NO: 6967 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnattggtgcnncaagagtcnntttttttttttttttttttttttttttttt

SEQ ID NO: 6968 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnaatcggcanntttttttttttttttttttttttttttttt

SEQ ID NO: 6969 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntacggcatnntttttttttttttttttttttttttttttt

SEQ ID NO: 6970 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnttggatcgnntttttttttttttttttttttttttttttt

SEQ ID NO: 6971 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntggaacganntttttttttttttttttttttttttttttt

SEQ ID NO: 6972 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnggcaatcanntttttttttttttttttttttttttttttt

SEQ ID NO: 6973 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngaatccganntttttttttttttttttttttttttttttt

SEQ ID NO: 6974 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnttacggtgnntttttttttttttttttttttttttttttt

SEQ ID NO: 6975 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncatatcggnntttttttttttttttttttttttttttttt

SEQ ID NO: 6976 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncttcggtanntttttttttttttttttttttttttttttt

SEQ ID NO: 6977 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntcctaacgnntttttttttttttttttttttttttttttt

SEQ ID NO: 6978 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngtaagccanntttttttttttttttttttttttttttttt

SEQ ID NO: 6979 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntaaggtggnntttttttttttttttttttttttttttttt

SEQ ID NO: 6980 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnggtaagctnntttttttttttttttttttttttttttttt

SEQ ID NO: 6981 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntgtgtcganntttttttttttttttttttttttttttttt

SEQ ID NO: 6982 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngagcatganntttttttttttttttttttttttttttttt

SEQ ID NO: 6983 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntcgaagtcnntttttttttttttttttttttttttttttt

SEQ ID NO: 6984 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnggtgaacanntttttttttttttttttttttttttttttt

SEQ ID NO: 6985 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnacatgcacnntttttttttttttttttttttttttttttt

SEQ ID NO: 6986 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnccaacagtnntttttttttttttttttttttttttttttt

SEQ ID NO: 6987 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnagaacagcnntttttttttttttttttttttttttttttt

SEQ ID NO: 6988 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngaacacgtnntttttttttttttttttttttttttttttt

SEQ ID NO: 6989 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnggtcttcanntttttttttttttttttttttttttttttt

SEQ ID NO: 6990 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnaggttcagnntttttttttttttttttttttttttttttt

SEQ ID NO: 6991 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnctagagcanntttttttttttttttttttttttttttttt

SEQ ID NO: 6992 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncttctagcnntttttttttttttttttttttttttttttt

SEQ ID NO: 6993 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngagtaacgnntttttttttttttttttttttttttttttt

SEQ ID NO: 6994 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnctaagaggnntttttttttttttttttttttttttttttt

SEQ ID NO: 6995 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnacgtgtagnntttttttttttttttttttttttttttttt

SEQ ID NO: 6996 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnactacaggnntttttttttttttttttttttttttttttt

SEQ ID NO: 6997 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntacaggtcnntttttttttttttttttttttttttttttt

SEQ ID NO: 6998 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnctcacatgnntttttttttttttttttttttttttttttt

SEQ ID NO: 6999 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnactaggagnntttttttttttttttttttttttttttttt

SEQ ID NO: 7000 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnccatagganntttttttttttttttttttttttttttttt

SEQ ID NO: 7001 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnggagaatcnntttttttttttttttttttttttttttttt

SEQ ID NO: 7002 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngccaagaanntttttttttttttttttttttttttttttt

SEQ ID NO: 7003 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnaaggcaagnntttttttttttttttttttttttttttttt

SEQ ID NO: 7004 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnaatgtcgcnntttttttttttttttttttttttttttttt

SEQ ID NO: 7005 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnatggaaccnntttttttttttttttttttttttttttttt

SEQ ID NO: 7006 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnagaggcatnntttttttttttttttttttttttttttttt

SEQ ID NO: 7007 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntgcatagcnntttttttttttttttttttttttttttttt

SEQ ID NO: 7008 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnctaacgganntttttttttttttttttttttttttttttt

SEQ ID NO: 7009 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntatcgaggnntttttttttttttttttttttttttttttt

SEQ ID NO: 7010 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncatagcctnntttttttttttttttttttttttttttttt

SEQ ID NO: 7011 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnatcgagacnntttttttttttttttttttttttttttttt

SEQ ID NO: 7012 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnggaagagtnntttttttttttttttttttttttttttttt

SEQ ID NO: 7013 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnccaagtagnntttttttttttttttttttttttttttttt

SEQ ID NO: 7014 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnctgaacagnntttttttttttttttttttttttttttttt

SEQ ID NO: 7015 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngtaggttcnntttttttttttttttttttttttttttttt

SEQ ID NO: 7016 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngtatggacnntttttttttttttttttttttttttttttt

SEQ ID NO: 7017 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntcgcaacanntttttttttttttttttttttttttttttt

SEQ ID NO: 7018 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnccgctaatnntttttttttttttttttttttttttttttt

SEQ ID NO: 7019 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngattcgcanntttttttttttttttttttttttttttttt

SEQ ID NO: 7020 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncgatggaanntttttttttttttttttttttttttttttt

SEQ ID NO: 7021 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnagcaagganntttttttttttttttttttttttttttttt

SEQ ID NO: 7022 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncgtagcaanntttttttttttttttttttttttttttttt

SEQ ID NO: 7023 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntggcagtanntttttttttttttttttttttttttttttt

SEQ ID NO: 7024 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncggtagttnntttttttttttttttttttttttttttttt

SEQ ID NO: 7025 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntgacttcgnntttttttttttttttttttttttttttttt

SEQ ID NO: 7026 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngagtgcaanntttttttttttttttttttttttttttttt

SEQ ID NO: 7027 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnacggtaacnntttttttttttttttttttttttttttttt

SEQ ID NO: 7028 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnaagtggtgnntttttttttttttttttttttttttttttt

SEQ ID NO: 7029 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnggagacaanntttttttttttttttttttttttttttttt

SEQ ID NO: 7030 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntcaaggacnntttttttttttttttttttttttttttttt

SEQ ID NO: 7031 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnaagagagcnntttttttttttttttttttttttttttttt

SEQ ID NO: 7032 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncgagagatnntttttttttttttttttttttttttttttt

SEQ ID NO: 7033 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnacagatggnntttttttttttttttttttttttttttttt

SEQ ID NO: 7034 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnaggagtcanntttttttttttttttttttttttttttttt

SEQ ID NO: 7035 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncgtgttacnntttttttttttttttttttttttttttttt

SEQ ID NO: 7036 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntagtgtgcnntttttttttttttttttttttttttttttt

SEQ ID NO: 7037 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnctcatgacnntttttttttttttttttttttttttttttt

SEQ ID NO: 7038 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngtatccagnntttttttttttttttttttttttttttttt

SEQ ID NO: 7039 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnacgcctatnntttttttttttttttttttttttttttttt

SEQ ID NO: 7040 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnaacgacctnntttttttttttttttttttttttttttttt

SEQ ID NO: 7041 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnatcaggctnntttttttttttttttttttttttttttttt

SEQ ID NO: 7042 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncaagttcgnntttttttttttttttttttttttttttttt

SEQ ID NO: 7043 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntagccaganntttttttttttttttttttttttttttttt

SEQ ID NO: 7044 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncaatcacgnntttttttttttttttttttttttttttttt

SEQ ID NO: 7045 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnngcaacaagnntttttttttttttttttttttttttttttt

SEQ ID NO: 7046 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncacgacaanntttttttttttttttttttttttttttttt

SEQ ID NO: 7047 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntacggaganntttttttttttttttttttttttttttttt

SEQ ID NO: 7048 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncgacaaganntttttttttttttttttttttttttttttt

SEQ ID NO: 7049 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncgaagtganntttttttttttttttttttttttttttttt

SEQ ID NO: 7050 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnagctggtanntttttttttttttttttttttttttttttt

SEQ ID NO: 7051 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnaactaggcnntttttttttttttttttttttttttttttt

SEQ ID NO: 7052 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncagcaagtnntttttttttttttttttttttttttttttt

SEQ ID NO: 7053 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnacgaggtanntttttttttttttttttttttttttttttt

SEQ ID NO: 7054 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncatcttccnntttttttttttttttttttttttttttttt

SEQ ID NO: 7055 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncctgaatcnntttttttttttttttttttttttttttttt

SEQ ID NO: 7056 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnntgcagactnntttttttttttttttttttttttttttttt

SEQ ID NO: 7057 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnagatgtggnntttttttttttttttttttttttttttttt

SEQ ID NO: 7058 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnagttcgacnntttttttttttttttttttttttttttttt

SEQ ID NO: 7059 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnnacaacctcnntttttttttttttttttttttttttttttt

SEQ ID NO: 7060 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncatggtagnntttttttttttttttttttttttttttttt

SEQ ID NO: 7061 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncgtatctcnntttttttttttttttttttttttttttttt

SEQ ID NO: 7062 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncctagttcnntttttttttttttttttttttttttttttt

SEQ ID NO: 7063 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggtggattnncaagagtcnntttttttttttttttttttttttttttttt

SEQ ID NO: 7064 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannaatcggcanntttttttttttttttttttttttttttttt

SEQ ID NO: 7065 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntacggcatnntttttttttttttttttttttttttttttt

SEQ ID NO: 7066 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannttggatcgnntttttttttttttttttttttttttttttt

SEQ ID NO: 7067 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntggaacganntttttttttttttttttttttttttttttt

SEQ ID NO: 7068 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannggcaatcanntttttttttttttttttttttttttttttt

SEQ ID NO: 7069 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngaatccganntttttttttttttttttttttttttttttt

SEQ ID NO: 7070 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannttacggtgnntttttttttttttttttttttttttttttt

SEQ ID NO: 7071 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncatatcggnntttttttttttttttttttttttttttttt

SEQ ID NO: 7072 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncttcggtanntttttttttttttttttttttttttttttt

SEQ ID NO: 7073 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntcctaacgnntttttttttttttttttttttttttttttt

SEQ ID NO: 7074 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngtaagccanntttttttttttttttttttttttttttttt

SEQ ID NO: 7075 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntaaggtggnntttttttttttttttttttttttttttttt

SEQ ID NO: 7076 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannggtaagctnntttttttttttttttttttttttttttttt

SEQ ID NO: 7077 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntgtgtcganntttttttttttttttttttttttttttttt

SEQ ID NO: 7078 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngagcatganntttttttttttttttttttttttttttttt

SEQ ID NO: 7079 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntcgaagtcnntttttttttttttttttttttttttttttt

SEQ ID NO: 7080 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannggtgaacanntttttttttttttttttttttttttttttt

SEQ ID NO: 7081 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannacatgcacnntttttttttttttttttttttttttttttt

SEQ ID NO: 7082 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannccaacagtnntttttttttttttttttttttttttttttt

SEQ ID NO: 7083 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannagaacagcnntttttttttttttttttttttttttttttt

SEQ ID NO: 7084 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngaacacgtnntttttttttttttttttttttttttttttt

SEQ ID NO: 7085 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannggtcttcanntttttttttttttttttttttttttttttt

SEQ ID NO: 7086 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannaggttcagnntttttttttttttttttttttttttttttt

SEQ ID NO: 7087 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannctagagcanntttttttttttttttttttttttttttttt

SEQ ID NO: 7088 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncttctagcnntttttttttttttttttttttttttttttt

SEQ ID NO: 7089 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngagtaacgnntttttttttttttttttttttttttttttt

SEQ ID NO: 7090 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannctaagaggnntttttttttttttttttttttttttttttt

SEQ ID NO: 7091 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannacgtgtagnntttttttttttttttttttttttttttttt

SEQ ID NO: 7092 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannactacaggnntttttttttttttttttttttttttttttt

SEQ ID NO: 7093 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntacaggtcnntttttttttttttttttttttttttttttt

SEQ ID NO: 7094 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannctcacatgnntttttttttttttttttttttttttttttt

SEQ ID NO: 7095 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannactaggagnntttttttttttttttttttttttttttttt

SEQ ID NO: 7096 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannccatagganntttttttttttttttttttttttttttttt

SEQ ID NO: 7097 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannggagaatcnntttttttttttttttttttttttttttttt

SEQ ID NO: 7098 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngccaagaanntttttttttttttttttttttttttttttt

SEQ ID NO: 7099 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannaaggcaagnntttttttttttttttttttttttttttttt

SEQ ID NO: 7100 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannaatgtcgcnntttttttttttttttttttttttttttttt

SEQ ID NO: 7101 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannatggaaccnntttttttttttttttttttttttttttttt

SEQ ID NO: 7102 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannagaggcatnntttttttttttttttttttttttttttttt

SEQ ID NO: 7103 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntgcatagcnntttttttttttttttttttttttttttttt

SEQ ID NO: 7104 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannctaacgganntttttttttttttttttttttttttttttt

SEQ ID NO: 7105 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntatcgaggnntttttttttttttttttttttttttttttt

SEQ ID NO: 7106 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncatagcctnntttttttttttttttttttttttttttttt

SEQ ID NO: 7107 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannatcgagacnntttttttttttttttttttttttttttttt

SEQ ID NO: 7108 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannggaagagtnntttttttttttttttttttttttttttttt

SEQ ID NO: 7109 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannccaagtagnntttttttttttttttttttttttttttttt

SEQ ID NO: 7110 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannctgaacagnntttttttttttttttttttttttttttttt

SEQ ID NO: 7111 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngtaggttcnntttttttttttttttttttttttttttttt

SEQ ID NO: 7112 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngtatggacnntttttttttttttttttttttttttttttt

SEQ ID NO: 7113 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntcgcaacanntttttttttttttttttttttttttttttt

SEQ ID NO: 7114 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannccgctaatnntttttttttttttttttttttttttttttt

SEQ ID NO: 7115 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngattcgcanntttttttttttttttttttttttttttttt

SEQ ID NO: 7116 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncgatggaanntttttttttttttttttttttttttttttt

SEQ ID NO: 7117 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannagcaagganntttttttttttttttttttttttttttttt

SEQ ID NO: 7118 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncgtagcaanntttttttttttttttttttttttttttttt

SEQ ID NO: 7119 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntggcagtanntttttttttttttttttttttttttttttt

SEQ ID NO: 7120 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncggtagttnntttttttttttttttttttttttttttttt

SEQ ID NO: 7121 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntgacttcgnntttttttttttttttttttttttttttttt

SEQ ID NO: 7122 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngagtgcaanntttttttttttttttttttttttttttttt

SEQ ID NO: 7123 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannacggtaacnntttttttttttttttttttttttttttttt

SEQ ID NO: 7124 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannaagtggtgnntttttttttttttttttttttttttttttt

SEQ ID NO: 7125 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannggagacaanntttttttttttttttttttttttttttttt

SEQ ID NO: 7126 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntcaaggacnntttttttttttttttttttttttttttttt

SEQ ID NO: 7127 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannaagagagcnntttttttttttttttttttttttttttttt

SEQ ID NO: 7128 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncgagagatnntttttttttttttttttttttttttttttt

SEQ ID NO: 7129 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannacagatggnntttttttttttttttttttttttttttttt

SEQ ID NO: 7130 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannaggagtcanntttttttttttttttttttttttttttttt

SEQ ID NO: 7131 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncgtgttacnntttttttttttttttttttttttttttttt

SEQ ID NO: 7132 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntagtgtgcnntttttttttttttttttttttttttttttt

SEQ ID NO: 7133 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannctcatgacnntttttttttttttttttttttttttttttt

SEQ ID NO: 7134 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngtatccagnntttttttttttttttttttttttttttttt

SEQ ID NO: 7135 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannacgcctatnntttttttttttttttttttttttttttttt

SEQ ID NO: 7136 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannaacgacctnntttttttttttttttttttttttttttttt

SEQ ID NO: 7137 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannatcaggctnntttttttttttttttttttttttttttttt

SEQ ID NO: 7138 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncaagttcgnntttttttttttttttttttttttttttttt

SEQ ID NO: 7139 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntagccaganntttttttttttttttttttttttttttttt

SEQ ID NO: 7140 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncaatcacgnntttttttttttttttttttttttttttttt

SEQ ID NO: 7141 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganngcaacaagnntttttttttttttttttttttttttttttt

SEQ ID NO: 7142 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncacgacaanntttttttttttttttttttttttttttttt

SEQ ID NO: 7143 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntacggaganntttttttttttttttttttttttttttttt

SEQ ID NO: 7144 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncgacaaganntttttttttttttttttttttttttttttt

SEQ ID NO: 7145 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncgaagtganntttttttttttttttttttttttttttttt

SEQ ID NO: 7146 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannagctggtanntttttttttttttttttttttttttttttt

SEQ ID NO: 7147 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannaactaggcnntttttttttttttttttttttttttttttt

SEQ ID NO: 7148 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncagcaagtnntttttttttttttttttttttttttttttt

SEQ ID NO: 7149 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannacgaggtanntttttttttttttttttttttttttttttt

SEQ ID NO: 7150 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncatcttccnntttttttttttttttttttttttttttttt

SEQ ID NO: 7151 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncctgaatcnntttttttttttttttttttttttttttttt

SEQ ID NO: 7152 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganntgcagactnntttttttttttttttttttttttttttttt

SEQ ID NO: 7153 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannagatgtggnntttttttttttttttttttttttttttttt

SEQ ID NO: 7154 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannagttcgacnntttttttttttttttttttttttttttttt

SEQ ID NO: 7155 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaagannacaacctcnntttttttttttttttttttttttttttttt

SEQ ID NO: 7156 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncatggtagnntttttttttttttttttttttttttttttt

SEQ ID NO: 7157 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncgtatctcnntttttttttttttttttttttttttttttt

SEQ ID NO: 7158 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncctagttcnntttttttttttttttttttttttttttttt

SEQ ID NO: 7159 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggctaaganncaagagtcnntttttttttttttttttttttttttttttt

SEQ ID NO: 7160 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnaatcggcanntttttttttttttttttttttttttttttt

SEQ ID NO: 7161 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntacggcatnntttttttttttttttttttttttttttttt

SEQ ID NO: 7162 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnttggatcgnntttttttttttttttttttttttttttttt

SEQ ID NO: 7163 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntggaacganntttttttttttttttttttttttttttttt

SEQ ID NO: 7164 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnggcaatcanntttttttttttttttttttttttttttttt

SEQ ID NO: 7165 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngaatccganntttttttttttttttttttttttttttttt

SEQ ID NO: 7166 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnttacggtgnntttttttttttttttttttttttttttttt

SEQ ID NO: 7167 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncatatcggnntttttttttttttttttttttttttttttt

SEQ ID NO: 7168 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncttcggtanntttttttttttttttttttttttttttttt

SEQ ID NO: 7169 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntcctaacgnntttttttttttttttttttttttttttttt

SEQ ID NO: 7170 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngtaagccanntttttttttttttttttttttttttttttt

SEQ ID NO: 7171 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntaaggtggnntttttttttttttttttttttttttttttt

SEQ ID NO: 7172 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnggtaagctnntttttttttttttttttttttttttttttt

SEQ ID NO: 7173 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntgtgtcganntttttttttttttttttttttttttttttt

SEQ ID NO: 7174 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngagcatganntttttttttttttttttttttttttttttt

SEQ ID NO: 7175 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntcgaagtcnntttttttttttttttttttttttttttttt

SEQ ID NO: 7176 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnggtgaacanntttttttttttttttttttttttttttttt

SEQ ID NO: 7177 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnacatgcacnntttttttttttttttttttttttttttttt

SEQ ID NO: 7178 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnccaacagtnntttttttttttttttttttttttttttttt

SEQ ID NO: 7179 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnagaacagcnntttttttttttttttttttttttttttttt

SEQ ID NO: 7180 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngaacacgtnntttttttttttttttttttttttttttttt

SEQ ID NO: 7181 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnggtcttcanntttttttttttttttttttttttttttttt

SEQ ID NO: 7182 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnaggttcagnntttttttttttttttttttttttttttttt

SEQ ID NO: 7183 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnctagagcanntttttttttttttttttttttttttttttt

SEQ ID NO: 7184 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncttctagcnntttttttttttttttttttttttttttttt

SEQ ID NO: 7185 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngagtaacgnntttttttttttttttttttttttttttttt

SEQ ID NO: 7186 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnctaagaggnntttttttttttttttttttttttttttttt

SEQ ID NO: 7187 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnacgtgtagnntttttttttttttttttttttttttttttt

SEQ ID NO: 7188 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnactacaggnntttttttttttttttttttttttttttttt

SEQ ID NO: 7189 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntacaggtcnntttttttttttttttttttttttttttttt

SEQ ID NO: 7190 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnctcacatgnntttttttttttttttttttttttttttttt

SEQ ID NO: 7191 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnactaggagnntttttttttttttttttttttttttttttt

SEQ ID NO: 7192 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnccatagganntttttttttttttttttttttttttttttt

SEQ ID NO: 7193 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnggagaatcnntttttttttttttttttttttttttttttt

SEQ ID NO: 7194 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngccaagaanntttttttttttttttttttttttttttttt

SEQ ID NO: 7195 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnaaggcaagnntttttttttttttttttttttttttttttt

SEQ ID NO: 7196 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnaatgtcgcnntttttttttttttttttttttttttttttt

SEQ ID NO: 7197 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnatggaaccnntttttttttttttttttttttttttttttt

SEQ ID NO: 7198 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnagaggcatnntttttttttttttttttttttttttttttt

SEQ ID NO: 7199 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntgcatagcnntttttttttttttttttttttttttttttt

SEQ ID NO: 7200 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnctaacgganntttttttttttttttttttttttttttttt

SEQ ID NO: 7201 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntatcgaggnntttttttttttttttttttttttttttttt

SEQ ID NO: 7202 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncatagcctnntttttttttttttttttttttttttttttt

SEQ ID NO: 7203 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnatcgagacnntttttttttttttttttttttttttttttt

SEQ ID NO: 7204 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnggaagagtnntttttttttttttttttttttttttttttt

SEQ ID NO: 7205 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnccaagtagnntttttttttttttttttttttttttttttt

SEQ ID NO: 7206 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnctgaacagnntttttttttttttttttttttttttttttt

SEQ ID NO: 7207 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngtaggttcnntttttttttttttttttttttttttttttt

SEQ ID NO: 7208 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngtatggacnntttttttttttttttttttttttttttttt

SEQ ID NO: 7209 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntcgcaacanntttttttttttttttttttttttttttttt

SEQ ID NO: 7210 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnccgctaatnntttttttttttttttttttttttttttttt

SEQ ID NO: 7211 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngattcgcanntttttttttttttttttttttttttttttt

SEQ ID NO: 7212 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncgatggaanntttttttttttttttttttttttttttttt

SEQ ID NO: 7213 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnagcaagganntttttttttttttttttttttttttttttt

SEQ ID NO: 7214 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncgtagcaanntttttttttttttttttttttttttttttt

SEQ ID NO: 7215 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntggcagtanntttttttttttttttttttttttttttttt

SEQ ID NO: 7216 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncggtagttnntttttttttttttttttttttttttttttt

SEQ ID NO: 7217 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntgacttcgnntttttttttttttttttttttttttttttt

SEQ ID NO: 7218 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngagtgcaanntttttttttttttttttttttttttttttt

SEQ ID NO: 7219 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnacggtaacnntttttttttttttttttttttttttttttt

SEQ ID NO: 7220 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnaagtggtgnntttttttttttttttttttttttttttttt

SEQ ID NO: 7221 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnggagacaanntttttttttttttttttttttttttttttt

SEQ ID NO: 7222 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntcaaggacnntttttttttttttttttttttttttttttt

SEQ ID NO: 7223 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnaagagagcnntttttttttttttttttttttttttttttt

SEQ ID NO: 7224 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncgagagatnntttttttttttttttttttttttttttttt

SEQ ID NO: 7225 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnacagatggnntttttttttttttttttttttttttttttt

SEQ ID NO: 7226 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnaggagtcanntttttttttttttttttttttttttttttt

SEQ ID NO: 7227 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncgtgttacnntttttttttttttttttttttttttttttt

SEQ ID NO: 7228 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntagtgtgcnntttttttttttttttttttttttttttttt

SEQ ID NO: 7229 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnctcatgacnntttttttttttttttttttttttttttttt

SEQ ID NO: 7230 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngtatccagnntttttttttttttttttttttttttttttt

SEQ ID NO: 7231 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnacgcctatnntttttttttttttttttttttttttttttt

SEQ ID NO: 7232 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnaacgacctnntttttttttttttttttttttttttttttt

SEQ ID NO: 7233 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnatcaggctnntttttttttttttttttttttttttttttt

SEQ ID NO: 7234 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncaagttcgnntttttttttttttttttttttttttttttt

SEQ ID NO: 7235 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntagccaganntttttttttttttttttttttttttttttt

SEQ ID NO: 7236 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncaatcacgnntttttttttttttttttttttttttttttt

SEQ ID NO: 7237 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnngcaacaagnntttttttttttttttttttttttttttttt

SEQ ID NO: 7238 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncacgacaanntttttttttttttttttttttttttttttt

SEQ ID NO: 7239 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntacggaganntttttttttttttttttttttttttttttt

SEQ ID NO: 7240 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncgacaaganntttttttttttttttttttttttttttttt

SEQ ID NO: 7241 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncgaagtganntttttttttttttttttttttttttttttt

SEQ ID NO: 7242 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnagctggtanntttttttttttttttttttttttttttttt

SEQ ID NO: 7243 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnaactaggcnntttttttttttttttttttttttttttttt

SEQ ID NO: 7244 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncagcaagtnntttttttttttttttttttttttttttttt

SEQ ID NO: 7245 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnacgaggtanntttttttttttttttttttttttttttttt

SEQ ID NO: 7246 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncatcttccnntttttttttttttttttttttttttttttt

SEQ ID NO: 7247 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncctgaatcnntttttttttttttttttttttttttttttt

SEQ ID NO: 7248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnntgcagactnntttttttttttttttttttttttttttttt

SEQ ID NO: 7249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnagatgtggnntttttttttttttttttttttttttttttt

SEQ ID NO: 7250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnagttcgacnntttttttttttttttttttttttttttttt

SEQ ID NO: 7251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnnacaacctcnntttttttttttttttttttttttttttttt

SEQ ID NO: 7252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncatggtagnntttttttttttttttttttttttttttttt

SEQ ID NO: 7253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncgtatctcnntttttttttttttttttttttttttttttt

SEQ ID NO: 7254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncctagttcnntttttttttttttttttttttttttttttt

SEQ ID NO: 7255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnttagaggcnncaagagtcnntttttttttttttttttttttttttttttt

SEQ ID NO: 7256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnaatcggcanntttttttttttttttttttttttttttttt

SEQ ID NO: 7257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntacggcatnntttttttttttttttttttttttttttttt

SEQ ID NO: 7258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnttggatcgnntttttttttttttttttttttttttttttt

SEQ ID NO: 7259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntggaacganntttttttttttttttttttttttttttttt

SEQ ID NO: 7260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnggcaatcanntttttttttttttttttttttttttttttt

SEQ ID NO: 7261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngaatccganntttttttttttttttttttttttttttttt

SEQ ID NO: 7262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnttacggtgnntttttttttttttttttttttttttttttt

SEQ ID NO: 7263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncatatcggnntttttttttttttttttttttttttttttt

SEQ ID NO: 7264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncttcggtanntttttttttttttttttttttttttttttt

SEQ ID NO: 7265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntcctaacgnntttttttttttttttttttttttttttttt

SEQ ID NO: 7266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngtaagccanntttttttttttttttttttttttttttttt

SEQ ID NO: 7267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntaaggtggnntttttttttttttttttttttttttttttt

SEQ ID NO: 7268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnggtaagctnntttttttttttttttttttttttttttttt

SEQ ID NO: 7269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntgtgtcganntttttttttttttttttttttttttttttt

SEQ ID NO: 7270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngagcatganntttttttttttttttttttttttttttttt

SEQ ID NO: 7271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntcgaagtcnntttttttttttttttttttttttttttttt

SEQ ID NO: 7272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnggtgaacanntttttttttttttttttttttttttttttt

SEQ ID NO: 7273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnacatgcacnntttttttttttttttttttttttttttttt

SEQ ID NO: 7274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnccaacagtnntttttttttttttttttttttttttttttt

SEQ ID NO: 7275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnagaacagcnntttttttttttttttttttttttttttttt

SEQ ID NO: 7276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngaacacgtnntttttttttttttttttttttttttttttt

SEQ ID NO: 7277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnggtcttcanntttttttttttttttttttttttttttttt

SEQ ID NO: 7278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnaggttcagnntttttttttttttttttttttttttttttt

SEQ ID NO: 7279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnctagagcanntttttttttttttttttttttttttttttt

SEQ ID NO: 7280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncttctagcnntttttttttttttttttttttttttttttt

SEQ ID NO: 7281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngagtaacgnntttttttttttttttttttttttttttttt

SEQ ID NO: 7282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnctaagaggnntttttttttttttttttttttttttttttt

SEQ ID NO: 7283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnacgtgtagnntttttttttttttttttttttttttttttt

SEQ ID NO: 7284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnactacaggnntttttttttttttttttttttttttttttt

SEQ ID NO: 7285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntacaggtcnntttttttttttttttttttttttttttttt

SEQ ID NO: 7286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnctcacatgnntttttttttttttttttttttttttttttt

SEQ ID NO: 7287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnactaggagnntttttttttttttttttttttttttttttt

SEQ ID NO: 7288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnccatagganntttttttttttttttttttttttttttttt

SEQ ID NO: 7289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnggagaatcnntttttttttttttttttttttttttttttt

SEQ ID NO: 7290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngccaagaanntttttttttttttttttttttttttttttt

SEQ ID NO: 7291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnaaggcaagnntttttttttttttttttttttttttttttt

SEQ ID NO: 7292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnaatgtcgcnntttttttttttttttttttttttttttttt

SEQ ID NO: 7293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnatggaaccnntttttttttttttttttttttttttttttt

SEQ ID NO: 7294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnagaggcatnntttttttttttttttttttttttttttttt

SEQ ID NO: 7295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntgcatagcnntttttttttttttttttttttttttttttt

SEQ ID NO: 7296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnctaacgganntttttttttttttttttttttttttttttt

SEQ ID NO: 7297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntatcgaggnntttttttttttttttttttttttttttttt

SEQ ID NO: 7298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncatagcctnntttttttttttttttttttttttttttttt

SEQ ID NO: 7299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnatcgagacnntttttttttttttttttttttttttttttt

SEQ ID NO: 7300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnggaagagtnntttttttttttttttttttttttttttttt

SEQ ID NO: 7301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnccaagtagnntttttttttttttttttttttttttttttt

SEQ ID NO: 7302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnctgaacagnntttttttttttttttttttttttttttttt

SEQ ID NO: 7303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngtaggttcnntttttttttttttttttttttttttttttt

SEQ ID NO: 7304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngtatggacnntttttttttttttttttttttttttttttt

SEQ ID NO: 7305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntcgcaacanntttttttttttttttttttttttttttttt

SEQ ID NO: 7306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnccgctaatnntttttttttttttttttttttttttttttt

SEQ ID NO: 7307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngattcgcanntttttttttttttttttttttttttttttt

SEQ ID NO: 7308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncgatggaanntttttttttttttttttttttttttttttt

SEQ ID NO: 7309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnagcaagganntttttttttttttttttttttttttttttt

SEQ ID NO: 7310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncgtagcaanntttttttttttttttttttttttttttttt

SEQ ID NO: 7311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntggcagtanntttttttttttttttttttttttttttttt

SEQ ID NO: 7312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncggtagttnntttttttttttttttttttttttttttttt

SEQ ID NO: 7313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntgacttcgnntttttttttttttttttttttttttttttt

SEQ ID NO: 7314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngagtgcaanntttttttttttttttttttttttttttttt

SEQ ID NO: 7315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnacggtaacnntttttttttttttttttttttttttttttt

SEQ ID NO: 7316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnaagtggtgnntttttttttttttttttttttttttttttt

SEQ ID NO: 7317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnggagacaanntttttttttttttttttttttttttttttt

SEQ ID NO: 7318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntcaaggacnntttttttttttttttttttttttttttttt

SEQ ID NO: 7319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnaagagagcnntttttttttttttttttttttttttttttt

SEQ ID NO: 7320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncgagagatnntttttttttttttttttttttttttttttt

SEQ ID NO: 7321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnacagatggnntttttttttttttttttttttttttttttt

SEQ ID NO: 7322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnaggagtcanntttttttttttttttttttttttttttttt

SEQ ID NO: 7323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncgtgttacnntttttttttttttttttttttttttttttt

SEQ ID NO: 7324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntagtgtgcnntttttttttttttttttttttttttttttt

SEQ ID NO: 7325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnctcatgacnntttttttttttttttttttttttttttttt

SEQ ID NO: 7326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngtatccagnntttttttttttttttttttttttttttttt

SEQ ID NO: 7327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnacgcctatnntttttttttttttttttttttttttttttt

SEQ ID NO: 7328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnaacgacctnntttttttttttttttttttttttttttttt

SEQ ID NO: 7329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnatcaggctnntttttttttttttttttttttttttttttt

SEQ ID NO: 7330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncaagttcgnntttttttttttttttttttttttttttttt

SEQ ID NO: 7331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntagccaganntttttttttttttttttttttttttttttt

SEQ ID NO: 7332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncaatcacgnntttttttttttttttttttttttttttttt

SEQ ID NO: 7333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnngcaacaagnntttttttttttttttttttttttttttttt

SEQ ID NO: 7334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncacgacaanntttttttttttttttttttttttttttttt

SEQ ID NO: 7335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntacggaganntttttttttttttttttttttttttttttt

SEQ ID NO: 7336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncgacaaganntttttttttttttttttttttttttttttt

SEQ ID NO: 7337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncgaagtganntttttttttttttttttttttttttttttt

SEQ ID NO: 7338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnagctggtanntttttttttttttttttttttttttttttt

SEQ ID NO: 7339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnaactaggcnntttttttttttttttttttttttttttttt

SEQ ID NO: 7340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncagcaagtnntttttttttttttttttttttttttttttt

SEQ ID NO: 7341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnacgaggtanntttttttttttttttttttttttttttttt

SEQ ID NO: 7342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncatcttccnntttttttttttttttttttttttttttttt

SEQ ID NO: 7343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncctgaatcnntttttttttttttttttttttttttttttt

SEQ ID NO: 7344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnntgcagactnntttttttttttttttttttttttttttttt

SEQ ID NO: 7345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnagatgtggnntttttttttttttttttttttttttttttt

SEQ ID NO: 7346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnagttcgacnntttttttttttttttttttttttttttttt

SEQ ID NO: 7347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnnacaacctcnntttttttttttttttttttttttttttttt

SEQ ID NO: 7348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncatggtagnntttttttttttttttttttttttttttttt

SEQ ID NO: 7349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncgtatctcnntttttttttttttttttttttttttttttt

SEQ ID NO: 7350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncctagttcnntttttttttttttttttttttttttttttt

SEQ ID NO: 7351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccattgtgnncaagagtcnntttttttttttttttttttttttttttttt

SEQ ID NO: 7352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnaatcggcanntttttttttttttttttttttttttttttt

SEQ ID NO: 7353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntacggcatnntttttttttttttttttttttttttttttt

SEQ ID NO: 7354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnttggatcgnntttttttttttttttttttttttttttttt

SEQ ID NO: 7355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntggaacganntttttttttttttttttttttttttttttt

SEQ ID NO: 7356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnggcaatcanntttttttttttttttttttttttttttttt

SEQ ID NO: 7357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngaatccganntttttttttttttttttttttttttttttt

SEQ ID NO: 7358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnttacggtgnntttttttttttttttttttttttttttttt

SEQ ID NO: 7359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncatatcggnntttttttttttttttttttttttttttttt

SEQ ID NO: 7360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncttcggtanntttttttttttttttttttttttttttttt

SEQ ID NO: 7361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntcctaacgnntttttttttttttttttttttttttttttt

SEQ ID NO: 7362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngtaagccanntttttttttttttttttttttttttttttt

SEQ ID NO: 7363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntaaggtggnntttttttttttttttttttttttttttttt

SEQ ID NO: 7364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnggtaagctnntttttttttttttttttttttttttttttt

SEQ ID NO: 7365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntgtgtcganntttttttttttttttttttttttttttttt

SEQ ID NO: 7366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngagcatganntttttttttttttttttttttttttttttt

SEQ ID NO: 7367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntcgaagtcnntttttttttttttttttttttttttttttt

SEQ ID NO: 7368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnggtgaacanntttttttttttttttttttttttttttttt

SEQ ID NO: 7369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnacatgcacnntttttttttttttttttttttttttttttt

SEQ ID NO: 7370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnccaacagtnntttttttttttttttttttttttttttttt

SEQ ID NO: 7371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnagaacagcnntttttttttttttttttttttttttttttt

SEQ ID NO: 7372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngaacacgtnntttttttttttttttttttttttttttttt

SEQ ID NO: 7373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnggtcttcanntttttttttttttttttttttttttttttt

SEQ ID NO: 7374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnaggttcagnntttttttttttttttttttttttttttttt

SEQ ID NO: 7375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnctagagcanntttttttttttttttttttttttttttttt

SEQ ID NO: 7376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncttctagcnntttttttttttttttttttttttttttttt

SEQ ID NO: 7377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngagtaacgnntttttttttttttttttttttttttttttt

SEQ ID NO: 7378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnctaagaggnntttttttttttttttttttttttttttttt

SEQ ID NO: 7379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnacgtgtagnntttttttttttttttttttttttttttttt

SEQ ID NO: 7380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnactacaggnntttttttttttttttttttttttttttttt

SEQ ID NO: 7381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntacaggtcnntttttttttttttttttttttttttttttt

SEQ ID NO: 7382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnctcacatgnntttttttttttttttttttttttttttttt

SEQ ID NO: 7383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnactaggagnntttttttttttttttttttttttttttttt

SEQ ID NO: 7384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnccatagganntttttttttttttttttttttttttttttt

SEQ ID NO: 7385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnggagaatcnntttttttttttttttttttttttttttttt

SEQ ID NO: 7386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngccaagaanntttttttttttttttttttttttttttttt

SEQ ID NO: 7387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnaaggcaagnntttttttttttttttttttttttttttttt

SEQ ID NO: 7388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnaatgtcgcnntttttttttttttttttttttttttttttt

SEQ ID NO: 7389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnatggaaccnntttttttttttttttttttttttttttttt

SEQ ID NO: 7390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnagaggcatnntttttttttttttttttttttttttttttt

SEQ ID NO: 7391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntgcatagcnntttttttttttttttttttttttttttttt

SEQ ID NO: 7392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnctaacgganntttttttttttttttttttttttttttttt

SEQ ID NO: 7393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntatcgaggnntttttttttttttttttttttttttttttt

SEQ ID NO: 7394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncatagcctnntttttttttttttttttttttttttttttt

SEQ ID NO: 7395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnatcgagacnntttttttttttttttttttttttttttttt

SEQ ID NO: 7396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnggaagagtnntttttttttttttttttttttttttttttt

SEQ ID NO: 7397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnccaagtagnntttttttttttttttttttttttttttttt

SEQ ID NO: 7398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnctgaacagnntttttttttttttttttttttttttttttt

SEQ ID NO: 7399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngtaggttcnntttttttttttttttttttttttttttttt

SEQ ID NO: 7400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngtatggacnntttttttttttttttttttttttttttttt

SEQ ID NO: 7401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntcgcaacanntttttttttttttttttttttttttttttt

SEQ ID NO: 7402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnccgctaatnntttttttttttttttttttttttttttttt

SEQ ID NO: 7403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngattcgcanntttttttttttttttttttttttttttttt

SEQ ID NO: 7404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncgatggaanntttttttttttttttttttttttttttttt

SEQ ID NO: 7405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnagcaagganntttttttttttttttttttttttttttttt

SEQ ID NO: 7406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncgtagcaanntttttttttttttttttttttttttttttt

SEQ ID NO: 7407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntggcagtanntttttttttttttttttttttttttttttt

SEQ ID NO: 7408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncggtagttnntttttttttttttttttttttttttttttt

SEQ ID NO: 7409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntgacttcgnntttttttttttttttttttttttttttttt

SEQ ID NO: 7410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngagtgcaanntttttttttttttttttttttttttttttt

SEQ ID NO: 7411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnacggtaacnntttttttttttttttttttttttttttttt

SEQ ID NO: 7412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnaagtggtgnntttttttttttttttttttttttttttttt

SEQ ID NO: 7413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnggagacaanntttttttttttttttttttttttttttttt

SEQ ID NO: 7414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntcaaggacnntttttttttttttttttttttttttttttt

SEQ ID NO: 7415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnaagagagcnntttttttttttttttttttttttttttttt

SEQ ID NO: 7416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncgagagatnntttttttttttttttttttttttttttttt

SEQ ID NO: 7417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnacagatggnntttttttttttttttttttttttttttttt

SEQ ID NO: 7418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnaggagtcanntttttttttttttttttttttttttttttt

SEQ ID NO: 7419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncgtgttacnntttttttttttttttttttttttttttttt

SEQ ID NO: 7420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntagtgtgcnntttttttttttttttttttttttttttttt

SEQ ID NO: 7421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnctcatgacnntttttttttttttttttttttttttttttt

SEQ ID NO: 7422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngtatccagnntttttttttttttttttttttttttttttt

SEQ ID NO: 7423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnacgcctatnntttttttttttttttttttttttttttttt

SEQ ID NO: 7424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnaacgacctnntttttttttttttttttttttttttttttt

SEQ ID NO: 7425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnatcaggctnntttttttttttttttttttttttttttttt

SEQ ID NO: 7426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncaagttcgnntttttttttttttttttttttttttttttt

SEQ ID NO: 7427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntagccaganntttttttttttttttttttttttttttttt

SEQ ID NO: 7428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncaatcacgnntttttttttttttttttttttttttttttt

SEQ ID NO: 7429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnngcaacaagnntttttttttttttttttttttttttttttt

SEQ ID NO: 7430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncacgacaanntttttttttttttttttttttttttttttt

SEQ ID NO: 7431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntacggaganntttttttttttttttttttttttttttttt

SEQ ID NO: 7432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncgacaaganntttttttttttttttttttttttttttttt

SEQ ID NO: 7433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncgaagtganntttttttttttttttttttttttttttttt

SEQ ID NO: 7434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnagctggtanntttttttttttttttttttttttttttttt

SEQ ID NO: 7435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnaactaggcnntttttttttttttttttttttttttttttt

SEQ ID NO: 7436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncagcaagtnntttttttttttttttttttttttttttttt

SEQ ID NO: 7437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnacgaggtanntttttttttttttttttttttttttttttt

SEQ ID NO: 7438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncatcttccnntttttttttttttttttttttttttttttt

SEQ ID NO: 7439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncctgaatcnntttttttttttttttttttttttttttttt

SEQ ID NO: 7440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnntgcagactnntttttttttttttttttttttttttttttt

SEQ ID NO: 7441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnagatgtggnntttttttttttttttttttttttttttttt

SEQ ID NO: 7442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnagttcgacnntttttttttttttttttttttttttttttt

SEQ ID NO: 7443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnnacaacctcnntttttttttttttttttttttttttttttt

SEQ ID NO: 7444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncatggtagnntttttttttttttttttttttttttttttt

SEQ ID NO: 7445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncgtatctcnntttttttttttttttttttttttttttttt

SEQ ID NO: 7446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncctagttcnntttttttttttttttttttttttttttttt

SEQ ID NO: 7447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncgagattgnncaagagtcnntttttttttttttttttttttttttttttt

SEQ ID NO: 7448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnaatcggcanntttttttttttttttttttttttttttttt

SEQ ID NO: 7449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntacggcatnntttttttttttttttttttttttttttttt

SEQ ID NO: 7450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnttggatcgnntttttttttttttttttttttttttttttt

SEQ ID NO: 7451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntggaacganntttttttttttttttttttttttttttttt

SEQ ID NO: 7452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnggcaatcanntttttttttttttttttttttttttttttt

SEQ ID NO: 7453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngaatccganntttttttttttttttttttttttttttttt

SEQ ID NO: 7454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnttacggtgnntttttttttttttttttttttttttttttt

SEQ ID NO: 7455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncatatcggnntttttttttttttttttttttttttttttt

SEQ ID NO: 7456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncttcggtanntttttttttttttttttttttttttttttt

SEQ ID NO: 7457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntcctaacgnntttttttttttttttttttttttttttttt

SEQ ID NO: 7458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngtaagccanntttttttttttttttttttttttttttttt

SEQ ID NO: 7459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntaaggtggnntttttttttttttttttttttttttttttt

SEQ ID NO: 7460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnggtaagctnntttttttttttttttttttttttttttttt

SEQ ID NO: 7461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntgtgtcganntttttttttttttttttttttttttttttt

SEQ ID NO: 7462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngagcatganntttttttttttttttttttttttttttttt

SEQ ID NO: 7463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntcgaagtcnntttttttttttttttttttttttttttttt

SEQ ID NO: 7464 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnggtgaacanntttttttttttttttttttttttttttttt

SEQ ID NO: 7465 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnacatgcacnntttttttttttttttttttttttttttttt

SEQ ID NO: 7466 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnccaacagtnntttttttttttttttttttttttttttttt

SEQ ID NO: 7467 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnagaacagcnntttttttttttttttttttttttttttttt

SEQ ID NO: 7468 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngaacacgtnntttttttttttttttttttttttttttttt

SEQ ID NO: 7469 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnggtcttcanntttttttttttttttttttttttttttttt

SEQ ID NO: 7470 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnaggttcagnntttttttttttttttttttttttttttttt

SEQ ID NO: 7471 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnctagagcanntttttttttttttttttttttttttttttt

SEQ ID NO: 7472 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncttctagcnntttttttttttttttttttttttttttttt

SEQ ID NO: 7473 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngagtaacgnntttttttttttttttttttttttttttttt

SEQ ID NO: 7474 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnctaagaggnntttttttttttttttttttttttttttttt

SEQ ID NO: 7475 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnacgtgtagnntttttttttttttttttttttttttttttt

SEQ ID NO: 7476 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnactacaggnntttttttttttttttttttttttttttttt

SEQ ID NO: 7477 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntacaggtcnntttttttttttttttttttttttttttttt

SEQ ID NO: 7478 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnctcacatgnntttttttttttttttttttttttttttttt

SEQ ID NO: 7479 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnactaggagnntttttttttttttttttttttttttttttt

SEQ ID NO: 7480 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnccatagganntttttttttttttttttttttttttttttt

SEQ ID NO: 7481 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnggagaatcnntttttttttttttttttttttttttttttt

SEQ ID NO: 7482 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngccaagaanntttttttttttttttttttttttttttttt

SEQ ID NO: 7483 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnaaggcaagnntttttttttttttttttttttttttttttt

SEQ ID NO: 7484 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnaatgtcgcnntttttttttttttttttttttttttttttt

SEQ ID NO: 7485 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnatggaaccnntttttttttttttttttttttttttttttt

SEQ ID NO: 7486 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnagaggcatnntttttttttttttttttttttttttttttt

SEQ ID NO: 7487 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntgcatagcnntttttttttttttttttttttttttttttt

SEQ ID NO: 7488 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnctaacgganntttttttttttttttttttttttttttttt

SEQ ID NO: 7489 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntatcgaggnntttttttttttttttttttttttttttttt

SEQ ID NO: 7490 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncatagcctnntttttttttttttttttttttttttttttt

SEQ ID NO: 7491 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnatcgagacnntttttttttttttttttttttttttttttt

SEQ ID NO: 7492 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnggaagagtnntttttttttttttttttttttttttttttt

SEQ ID NO: 7493 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnccaagtagnntttttttttttttttttttttttttttttt

SEQ ID NO: 7494 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnctgaacagnntttttttttttttttttttttttttttttt

SEQ ID NO: 7495 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngtaggttcnntttttttttttttttttttttttttttttt

SEQ ID NO: 7496 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngtatggacnntttttttttttttttttttttttttttttt

SEQ ID NO: 7497 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntcgcaacanntttttttttttttttttttttttttttttt

SEQ ID NO: 7498 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnccgctaatnntttttttttttttttttttttttttttttt

SEQ ID NO: 7499 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngattcgcanntttttttttttttttttttttttttttttt

SEQ ID NO: 7500 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncgatggaanntttttttttttttttttttttttttttttt

SEQ ID NO: 7501 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnagcaagganntttttttttttttttttttttttttttttt

SEQ ID NO: 7502 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncgtagcaanntttttttttttttttttttttttttttttt

SEQ ID NO: 7503 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntggcagtanntttttttttttttttttttttttttttttt

SEQ ID NO: 7504 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncggtagttnntttttttttttttttttttttttttttttt

SEQ ID NO: 7505 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntgacttcgnntttttttttttttttttttttttttttttt

SEQ ID NO: 7506 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngagtgcaanntttttttttttttttttttttttttttttt

SEQ ID NO: 7507 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnacggtaacnntttttttttttttttttttttttttttttt

SEQ ID NO: 7508 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnaagtggtgnntttttttttttttttttttttttttttttt

SEQ ID NO: 7509 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnggagacaanntttttttttttttttttttttttttttttt

SEQ ID NO: 7510 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntcaaggacnntttttttttttttttttttttttttttttt

SEQ ID NO: 7511 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnaagagagcnntttttttttttttttttttttttttttttt

SEQ ID NO: 7512 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncgagagatnntttttttttttttttttttttttttttttt

SEQ ID NO: 7513 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnacagatggnntttttttttttttttttttttttttttttt

SEQ ID NO: 7514 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnaggagtcanntttttttttttttttttttttttttttttt

SEQ ID NO: 7515 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncgtgttacnntttttttttttttttttttttttttttttt

SEQ ID NO: 7516 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntagtgtgcnntttttttttttttttttttttttttttttt

SEQ ID NO: 7517 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnctcatgacnntttttttttttttttttttttttttttttt

SEQ ID NO: 7518 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngtatccagnntttttttttttttttttttttttttttttt

SEQ ID NO: 7519 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnacgcctatnntttttttttttttttttttttttttttttt

SEQ ID NO: 7520 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnaacgacctnntttttttttttttttttttttttttttttt

SEQ ID NO: 7521 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnatcaggctnntttttttttttttttttttttttttttttt

SEQ ID NO: 7522 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncaagttcgnntttttttttttttttttttttttttttttt

SEQ ID NO: 7523 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntagccaganntttttttttttttttttttttttttttttt

SEQ ID NO: 7524 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncaatcacgnntttttttttttttttttttttttttttttt

SEQ ID NO: 7525 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnngcaacaagnntttttttttttttttttttttttttttttt

SEQ ID NO: 7526 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncacgacaanntttttttttttttttttttttttttttttt

SEQ ID NO: 7527 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntacggaganntttttttttttttttttttttttttttttt

SEQ ID NO: 7528 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncgacaaganntttttttttttttttttttttttttttttt

SEQ ID NO: 7529 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncgaagtganntttttttttttttttttttttttttttttt

SEQ ID NO: 7530 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnagctggtanntttttttttttttttttttttttttttttt

SEQ ID NO: 7531 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnaactaggcnntttttttttttttttttttttttttttttt

SEQ ID NO: 7532 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncagcaagtnntttttttttttttttttttttttttttttt

SEQ ID NO: 7533 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnacgaggtanntttttttttttttttttttttttttttttt

SEQ ID NO: 7534 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncatcttccnntttttttttttttttttttttttttttttt

SEQ ID NO: 7535 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncctgaatcnntttttttttttttttttttttttttttttt

SEQ ID NO: 7536 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnntgcagactnntttttttttttttttttttttttttttttt

SEQ ID NO: 7537 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnagatgtggnntttttttttttttttttttttttttttttt

SEQ ID NO: 7538 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnagttcgacnntttttttttttttttttttttttttttttt

SEQ ID NO: 7539 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnnacaacctcnntttttttttttttttttttttttttttttt

SEQ ID NO: 7540 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncatggtagnntttttttttttttttttttttttttttttt

SEQ ID NO: 7541 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncgtatctcnntttttttttttttttttttttttttttttt

SEQ ID NO: 7542 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncctagttcnntttttttttttttttttttttttttttttt

SEQ ID NO: 7543 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgtggaagnncaagagtcnntttttttttttttttttttttttttttttt

SEQ ID NO: 7544 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnaatcggcanntttttttttttttttttttttttttttttt

SEQ ID NO: 7545 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntacggcatnntttttttttttttttttttttttttttttt

SEQ ID NO: 7546 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnttggatcgnntttttttttttttttttttttttttttttt

SEQ ID NO: 7547 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntggaacganntttttttttttttttttttttttttttttt

SEQ ID NO: 7548 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnggcaatcanntttttttttttttttttttttttttttttt

SEQ ID NO: 7549 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngaatccganntttttttttttttttttttttttttttttt

SEQ ID NO: 7550 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnttacggtgnntttttttttttttttttttttttttttttt

SEQ ID NO: 7551 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncatatcggnntttttttttttttttttttttttttttttt

SEQ ID NO: 7552 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncttcggtanntttttttttttttttttttttttttttttt

SEQ ID NO: 7553 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntcctaacgnntttttttttttttttttttttttttttttt

SEQ ID NO: 7554 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngtaagccanntttttttttttttttttttttttttttttt

SEQ ID NO: 7555 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntaaggtggnntttttttttttttttttttttttttttttt

SEQ ID NO: 7556 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnggtaagctnntttttttttttttttttttttttttttttt

SEQ ID NO: 7557 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntgtgtcganntttttttttttttttttttttttttttttt

SEQ ID NO: 7558 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngagcatganntttttttttttttttttttttttttttttt

SEQ ID NO: 7559 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntcgaagtcnntttttttttttttttttttttttttttttt

SEQ ID NO: 7560 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnggtgaacanntttttttttttttttttttttttttttttt

SEQ ID NO: 7561 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnacatgcacnntttttttttttttttttttttttttttttt

SEQ ID NO: 7562 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnccaacagtnntttttttttttttttttttttttttttttt

SEQ ID NO: 7563 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnagaacagcnntttttttttttttttttttttttttttttt

SEQ ID NO: 7564 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngaacacgtnntttttttttttttttttttttttttttttt

SEQ ID NO: 7565 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnggtcttcanntttttttttttttttttttttttttttttt

SEQ ID NO: 7566 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnaggttcagnntttttttttttttttttttttttttttttt

SEQ ID NO: 7567 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnctagagcanntttttttttttttttttttttttttttttt

SEQ ID NO: 7568 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncttctagcnntttttttttttttttttttttttttttttt

SEQ ID NO: 7569 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngagtaacgnntttttttttttttttttttttttttttttt

SEQ ID NO: 7570 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnctaagaggnntttttttttttttttttttttttttttttt

SEQ ID NO: 7571 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnacgtgtagnntttttttttttttttttttttttttttttt

SEQ ID NO: 7572 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnactacaggnntttttttttttttttttttttttttttttt

SEQ ID NO: 7573 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntacaggtcnntttttttttttttttttttttttttttttt

SEQ ID NO: 7574 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnctcacatgnntttttttttttttttttttttttttttttt

SEQ ID NO: 7575 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnactaggagnntttttttttttttttttttttttttttttt

SEQ ID NO: 7576 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnccatagganntttttttttttttttttttttttttttttt

SEQ ID NO: 7577 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnggagaatcnntttttttttttttttttttttttttttttt

SEQ ID NO: 7578 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngccaagaanntttttttttttttttttttttttttttttt

SEQ ID NO: 7579 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnaaggcaagnntttttttttttttttttttttttttttttt

SEQ ID NO: 7580 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnaatgtcgcnntttttttttttttttttttttttttttttt

SEQ ID NO: 7581 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnatggaaccnntttttttttttttttttttttttttttttt

SEQ ID NO: 7582 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnagaggcatnntttttttttttttttttttttttttttttt

SEQ ID NO: 7583 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntgcatagcnntttttttttttttttttttttttttttttt

SEQ ID NO: 7584 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnctaacgganntttttttttttttttttttttttttttttt

SEQ ID NO: 7585 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntatcgaggnntttttttttttttttttttttttttttttt

SEQ ID NO: 7586 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncatagcctnntttttttttttttttttttttttttttttt

SEQ ID NO: 7587 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnatcgagacnntttttttttttttttttttttttttttttt

SEQ ID NO: 7588 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnggaagagtnntttttttttttttttttttttttttttttt

SEQ ID NO: 7589 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnccaagtagnntttttttttttttttttttttttttttttt

SEQ ID NO: 7590 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnctgaacagnntttttttttttttttttttttttttttttt

SEQ ID NO: 7591 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngtaggttcnntttttttttttttttttttttttttttttt

SEQ ID NO: 7592 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngtatggacnntttttttttttttttttttttttttttttt

SEQ ID NO: 7593 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntcgcaacanntttttttttttttttttttttttttttttt

SEQ ID NO: 7594 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnccgctaatnntttttttttttttttttttttttttttttt

SEQ ID NO: 7595 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngattcgcanntttttttttttttttttttttttttttttt

SEQ ID NO: 7596 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncgatggaanntttttttttttttttttttttttttttttt

SEQ ID NO: 7597 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnagcaagganntttttttttttttttttttttttttttttt

SEQ ID NO: 7598 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncgtagcaanntttttttttttttttttttttttttttttt

SEQ ID NO: 7599 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntggcagtanntttttttttttttttttttttttttttttt

SEQ ID NO: 7600 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncggtagttnntttttttttttttttttttttttttttttt

SEQ ID NO: 7601 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntgacttcgnntttttttttttttttttttttttttttttt

SEQ ID NO: 7602 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngagtgcaanntttttttttttttttttttttttttttttt

SEQ ID NO: 7603 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnacggtaacnntttttttttttttttttttttttttttttt

SEQ ID NO: 7604 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnaagtggtgnntttttttttttttttttttttttttttttt

SEQ ID NO: 7605 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnggagacaanntttttttttttttttttttttttttttttt

SEQ ID NO: 7606 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntcaaggacnntttttttttttttttttttttttttttttt

SEQ ID NO: 7607 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnaagagagcnntttttttttttttttttttttttttttttt

SEQ ID NO: 7608 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncgagagatnntttttttttttttttttttttttttttttt

SEQ ID NO: 7609 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnacagatggnntttttttttttttttttttttttttttttt

SEQ ID NO: 7610 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnaggagtcanntttttttttttttttttttttttttttttt

SEQ ID NO: 7611 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncgtgttacnntttttttttttttttttttttttttttttt

SEQ ID NO: 7612 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntagtgtgcnntttttttttttttttttttttttttttttt

SEQ ID NO: 7613 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnctcatgacnntttttttttttttttttttttttttttttt

SEQ ID NO: 7614 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngtatccagnntttttttttttttttttttttttttttttt

SEQ ID NO: 7615 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnacgcctatnntttttttttttttttttttttttttttttt

SEQ ID NO: 7616 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnaacgacctnntttttttttttttttttttttttttttttt

SEQ ID NO: 7617 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnatcaggctnntttttttttttttttttttttttttttttt

SEQ ID NO: 7618 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncaagttcgnntttttttttttttttttttttttttttttt

SEQ ID NO: 7619 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntagccaganntttttttttttttttttttttttttttttt

SEQ ID NO: 7620 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncaatcacgnntttttttttttttttttttttttttttttt

SEQ ID NO: 7621 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnngcaacaagnntttttttttttttttttttttttttttttt

SEQ ID NO: 7622 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncacgacaanntttttttttttttttttttttttttttttt

SEQ ID NO: 7623 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntacggaganntttttttttttttttttttttttttttttt

SEQ ID NO: 7624 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncgacaaganntttttttttttttttttttttttttttttt

SEQ ID NO: 7625 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncgaagtganntttttttttttttttttttttttttttttt

SEQ ID NO: 7626 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnagctggtanntttttttttttttttttttttttttttttt

SEQ ID NO: 7627 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnaactaggcnntttttttttttttttttttttttttttttt

SEQ ID NO: 7628 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncagcaagtnntttttttttttttttttttttttttttttt

SEQ ID NO: 7629 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnacgaggtanntttttttttttttttttttttttttttttt

SEQ ID NO: 7630 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncatcttccnntttttttttttttttttttttttttttttt

SEQ ID NO: 7631 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncctgaatcnntttttttttttttttttttttttttttttt

SEQ ID NO: 7632 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnntgcagactnntttttttttttttttttttttttttttttt

SEQ ID NO: 7633 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnagatgtggnntttttttttttttttttttttttttttttt

SEQ ID NO: 7634 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnagttcgacnntttttttttttttttttttttttttttttt

SEQ ID NO: 7635 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnnacaacctcnntttttttttttttttttttttttttttttt

SEQ ID NO: 7636 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncatggtagnntttttttttttttttttttttttttttttt

SEQ ID NO: 7637 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncgtatctcnntttttttttttttttttttttttttttttt

SEQ ID NO: 7638 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncctagttcnntttttttttttttttttttttttttttttt

SEQ ID NO: 7639 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcttgtggnncaagagtcnntttttttttttttttttttttttttttttt

SEQ ID NO: 7640 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannaatcggcanntttttttttttttttttttttttttttttt

SEQ ID NO: 7641 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntacggcatnntttttttttttttttttttttttttttttt

SEQ ID NO: 7642 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannttggatcgnntttttttttttttttttttttttttttttt

SEQ ID NO: 7643 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntggaacganntttttttttttttttttttttttttttttt

SEQ ID NO: 7644 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannggcaatcanntttttttttttttttttttttttttttttt

SEQ ID NO: 7645 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngaatccganntttttttttttttttttttttttttttttt

SEQ ID NO: 7646 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannttacggtgnntttttttttttttttttttttttttttttt

SEQ ID NO: 7647 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncatatcggnntttttttttttttttttttttttttttttt

SEQ ID NO: 7648 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncttcggtanntttttttttttttttttttttttttttttt

SEQ ID NO: 7649 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntcctaacgnntttttttttttttttttttttttttttttt

SEQ ID NO: 7650 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngtaagccanntttttttttttttttttttttttttttttt

SEQ ID NO: 7651 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntaaggtggnntttttttttttttttttttttttttttttt

SEQ ID NO: 7652 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannggtaagctnntttttttttttttttttttttttttttttt

SEQ ID NO: 7653 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntgtgtcganntttttttttttttttttttttttttttttt

SEQ ID NO: 7654 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngagcatganntttttttttttttttttttttttttttttt

SEQ ID NO: 7655 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntcgaagtcnntttttttttttttttttttttttttttttt

SEQ ID NO: 7656 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannggtgaacanntttttttttttttttttttttttttttttt

SEQ ID NO: 7657 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannacatgcacnntttttttttttttttttttttttttttttt

SEQ ID NO: 7658 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannccaacagtnntttttttttttttttttttttttttttttt

SEQ ID NO: 7659 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannagaacagcnntttttttttttttttttttttttttttttt

SEQ ID NO: 7660 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngaacacgtnntttttttttttttttttttttttttttttt

SEQ ID NO: 7661 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannggtcttcanntttttttttttttttttttttttttttttt

SEQ ID NO: 7662 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannaggttcagnntttttttttttttttttttttttttttttt

SEQ ID NO: 7663 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannctagagcanntttttttttttttttttttttttttttttt

SEQ ID NO: 7664 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncttctagcnntttttttttttttttttttttttttttttt

SEQ ID NO: 7665 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngagtaacgnntttttttttttttttttttttttttttttt

SEQ ID NO: 7666 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannctaagaggnntttttttttttttttttttttttttttttt

SEQ ID NO: 7667 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannacgtgtagnntttttttttttttttttttttttttttttt

SEQ ID NO: 7668 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannactacaggnntttttttttttttttttttttttttttttt

SEQ ID NO: 7669 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntacaggtcnntttttttttttttttttttttttttttttt

SEQ ID NO: 7670 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannctcacatgnntttttttttttttttttttttttttttttt

SEQ ID NO: 7671 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannactaggagnntttttttttttttttttttttttttttttt

SEQ ID NO: 7672 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannccatagganntttttttttttttttttttttttttttttt

SEQ ID NO: 7673 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannggagaatcnntttttttttttttttttttttttttttttt

SEQ ID NO: 7674 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngccaagaanntttttttttttttttttttttttttttttt

SEQ ID NO: 7675 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannaaggcaagnntttttttttttttttttttttttttttttt

SEQ ID NO: 7676 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannaatgtcgcnntttttttttttttttttttttttttttttt

SEQ ID NO: 7677 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannatggaaccnntttttttttttttttttttttttttttttt

SEQ ID NO: 7678 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannagaggcatnntttttttttttttttttttttttttttttt

SEQ ID NO: 7679 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntgcatagcnntttttttttttttttttttttttttttttt

SEQ ID NO: 7680 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannctaacgganntttttttttttttttttttttttttttttt

SEQ ID NO: 7681 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntatcgaggnntttttttttttttttttttttttttttttt

SEQ ID NO: 7682 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncatagcctnntttttttttttttttttttttttttttttt

SEQ ID NO: 7683 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannatcgagacnntttttttttttttttttttttttttttttt

SEQ ID NO: 7684 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannggaagagtnntttttttttttttttttttttttttttttt

SEQ ID NO: 7685 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannccaagtagnntttttttttttttttttttttttttttttt

SEQ ID NO: 7686 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannctgaacagnntttttttttttttttttttttttttttttt

SEQ ID NO: 7687 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngtaggttcnntttttttttttttttttttttttttttttt

SEQ ID NO: 7688 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngtatggacnntttttttttttttttttttttttttttttt

SEQ ID NO: 7689 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntcgcaacanntttttttttttttttttttttttttttttt

SEQ ID NO: 7690 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannccgctaatnntttttttttttttttttttttttttttttt

SEQ ID NO: 7691 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngattcgcanntttttttttttttttttttttttttttttt

SEQ ID NO: 7692 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncgatggaanntttttttttttttttttttttttttttttt

SEQ ID NO: 7693 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannagcaagganntttttttttttttttttttttttttttttt

SEQ ID NO: 7694 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncgtagcaanntttttttttttttttttttttttttttttt

SEQ ID NO: 7695 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntggcagtanntttttttttttttttttttttttttttttt

SEQ ID NO: 7696 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncggtagttnntttttttttttttttttttttttttttttt

SEQ ID NO: 7697 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntgacttcgnntttttttttttttttttttttttttttttt

SEQ ID NO: 7698 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngagtgcaanntttttttttttttttttttttttttttttt

SEQ ID NO: 7699 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannacggtaacnntttttttttttttttttttttttttttttt

SEQ ID NO: 7700 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannaagtggtgnntttttttttttttttttttttttttttttt

SEQ ID NO: 7701 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannggagacaanntttttttttttttttttttttttttttttt

SEQ ID NO: 7702 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntcaaggacnntttttttttttttttttttttttttttttt

SEQ ID NO: 7703 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannaagagagcnntttttttttttttttttttttttttttttt

SEQ ID NO: 7704 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncgagagatnntttttttttttttttttttttttttttttt

SEQ ID NO: 7705 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannacagatggnntttttttttttttttttttttttttttttt

SEQ ID NO: 7706 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannaggagtcanntttttttttttttttttttttttttttttt

SEQ ID NO: 7707 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncgtgttacnntttttttttttttttttttttttttttttt

SEQ ID NO: 7708 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntagtgtgcnntttttttttttttttttttttttttttttt

SEQ ID NO: 7709 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannctcatgacnntttttttttttttttttttttttttttttt

SEQ ID NO: 7710 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngtatccagnntttttttttttttttttttttttttttttt

SEQ ID NO: 7711 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannacgcctatnntttttttttttttttttttttttttttttt

SEQ ID NO: 7712 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannaacgacctnntttttttttttttttttttttttttttttt

SEQ ID NO: 7713 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannatcaggctnntttttttttttttttttttttttttttttt

SEQ ID NO: 7714 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncaagttcgnntttttttttttttttttttttttttttttt

SEQ ID NO: 7715 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntagccaganntttttttttttttttttttttttttttttt

SEQ ID NO: 7716 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncaatcacgnntttttttttttttttttttttttttttttt

SEQ ID NO: 7717 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganngcaacaagnntttttttttttttttttttttttttttttt

SEQ ID NO: 7718 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncacgacaanntttttttttttttttttttttttttttttt

SEQ ID NO: 7719 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntacggaganntttttttttttttttttttttttttttttt

SEQ ID NO: 7720 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncgacaaganntttttttttttttttttttttttttttttt

SEQ ID NO: 7721 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncgaagtganntttttttttttttttttttttttttttttt

SEQ ID NO: 7722 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannagctggtanntttttttttttttttttttttttttttttt

SEQ ID NO: 7723 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannaactaggcnntttttttttttttttttttttttttttttt

SEQ ID NO: 7724 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncagcaagtnntttttttttttttttttttttttttttttt

SEQ ID NO: 7725 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannacgaggtanntttttttttttttttttttttttttttttt

SEQ ID NO: 7726 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncatcttccnntttttttttttttttttttttttttttttt

SEQ ID NO: 7727 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncctgaatcnntttttttttttttttttttttttttttttt

SEQ ID NO: 7728 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganntgcagactnntttttttttttttttttttttttttttttt

SEQ ID NO: 7729 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannagatgtggnntttttttttttttttttttttttttttttt

SEQ ID NO: 7730 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannagttcgacnntttttttttttttttttttttttttttttt

SEQ ID NO: 7731 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcagannacaacctcnntttttttttttttttttttttttttttttt

SEQ ID NO: 7732 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncatggtagnntttttttttttttttttttttttttttttt

SEQ ID NO: 7733 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncgtatctcnntttttttttttttttttttttttttttttt

SEQ ID NO: 7734 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncctagttcnntttttttttttttttttttttttttttttt

SEQ ID NO: 7735 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnccttcaganncaagagtcnntttttttttttttttttttttttttttttt

SEQ ID NO: 7736 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnaatcggcanntttttttttttttttttttttttttttttt

SEQ ID NO: 7737 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntacggcatnntttttttttttttttttttttttttttttt

SEQ ID NO: 7738 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnttggatcgnntttttttttttttttttttttttttttttt

SEQ ID NO: 7739 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntggaacganntttttttttttttttttttttttttttttt

SEQ ID NO: 7740 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnggcaatcanntttttttttttttttttttttttttttttt

SEQ ID NO: 7741 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngaatccganntttttttttttttttttttttttttttttt

SEQ ID NO: 7742 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnttacggtgnntttttttttttttttttttttttttttttt

SEQ ID NO: 7743 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncatatcggnntttttttttttttttttttttttttttttt

SEQ ID NO: 7744 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncttcggtanntttttttttttttttttttttttttttttt

SEQ ID NO: 7745 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntcctaacgnntttttttttttttttttttttttttttttt

SEQ ID NO: 7746 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngtaagccanntttttttttttttttttttttttttttttt

SEQ ID NO: 7747 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntaaggtggnntttttttttttttttttttttttttttttt

SEQ ID NO: 7748 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnggtaagctnntttttttttttttttttttttttttttttt

SEQ ID NO: 7749 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntgtgtcganntttttttttttttttttttttttttttttt

SEQ ID NO: 7750 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngagcatganntttttttttttttttttttttttttttttt

SEQ ID NO: 7751 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntcgaagtcnntttttttttttttttttttttttttttttt

SEQ ID NO: 7752 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnggtgaacanntttttttttttttttttttttttttttttt

SEQ ID NO: 7753 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnacatgcacnntttttttttttttttttttttttttttttt

SEQ ID NO: 7754 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnccaacagtnntttttttttttttttttttttttttttttt

SEQ ID NO: 7755 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnagaacagcnntttttttttttttttttttttttttttttt

SEQ ID NO: 7756 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngaacacgtnntttttttttttttttttttttttttttttt

SEQ ID NO: 7757 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnggtcttcanntttttttttttttttttttttttttttttt

SEQ ID NO: 7758 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnaggttcagnntttttttttttttttttttttttttttttt

SEQ ID NO: 7759 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnctagagcanntttttttttttttttttttttttttttttt

SEQ ID NO: 7760 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncttctagcnntttttttttttttttttttttttttttttt

SEQ ID NO: 7761 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngagtaacgnntttttttttttttttttttttttttttttt

SEQ ID NO: 7762 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnctaagaggnntttttttttttttttttttttttttttttt

SEQ ID NO: 7763 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnacgtgtagnntttttttttttttttttttttttttttttt

SEQ ID NO: 7764 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnactacaggnntttttttttttttttttttttttttttttt

SEQ ID NO: 7765 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntacaggtcnntttttttttttttttttttttttttttttt

SEQ ID NO: 7766 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnctcacatgnntttttttttttttttttttttttttttttt

SEQ ID NO: 7767 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnactaggagnntttttttttttttttttttttttttttttt

SEQ ID NO: 7768 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnccatagganntttttttttttttttttttttttttttttt

SEQ ID NO: 7769 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnggagaatcnntttttttttttttttttttttttttttttt

SEQ ID NO: 7770 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngccaagaanntttttttttttttttttttttttttttttt

SEQ ID NO: 7771 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnaaggcaagnntttttttttttttttttttttttttttttt

SEQ ID NO: 7772 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnaatgtcgcnntttttttttttttttttttttttttttttt

SEQ ID NO: 7773 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnatggaaccnntttttttttttttttttttttttttttttt

SEQ ID NO: 7774 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnagaggcatnntttttttttttttttttttttttttttttt

SEQ ID NO: 7775 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntgcatagcnntttttttttttttttttttttttttttttt

SEQ ID NO: 7776 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnctaacgganntttttttttttttttttttttttttttttt

SEQ ID NO: 7777 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntatcgaggnntttttttttttttttttttttttttttttt

SEQ ID NO: 7778 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncatagcctnntttttttttttttttttttttttttttttt

SEQ ID NO: 7779 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnatcgagacnntttttttttttttttttttttttttttttt

SEQ ID NO: 7780 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnggaagagtnntttttttttttttttttttttttttttttt

SEQ ID NO: 7781 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnccaagtagnntttttttttttttttttttttttttttttt

SEQ ID NO: 7782 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnctgaacagnntttttttttttttttttttttttttttttt

SEQ ID NO: 7783 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngtaggttcnntttttttttttttttttttttttttttttt

SEQ ID NO: 7784 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngtatggacnntttttttttttttttttttttttttttttt

SEQ ID NO: 7785 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntcgcaacanntttttttttttttttttttttttttttttt

SEQ ID NO: 7786 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnccgctaatnntttttttttttttttttttttttttttttt

SEQ ID NO: 7787 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngattcgcanntttttttttttttttttttttttttttttt

SEQ ID NO: 7788 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncgatggaanntttttttttttttttttttttttttttttt

SEQ ID NO: 7789 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnagcaagganntttttttttttttttttttttttttttttt

SEQ ID NO: 7790 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncgtagcaanntttttttttttttttttttttttttttttt

SEQ ID NO: 7791 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntggcagtanntttttttttttttttttttttttttttttt

SEQ ID NO: 7792 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncggtagttnntttttttttttttttttttttttttttttt

SEQ ID NO: 7793 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntgacttcgnntttttttttttttttttttttttttttttt

SEQ ID NO: 7794 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngagtgcaanntttttttttttttttttttttttttttttt

SEQ ID NO: 7795 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnacggtaacnntttttttttttttttttttttttttttttt

SEQ ID NO: 7796 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnaagtggtgnntttttttttttttttttttttttttttttt

SEQ ID NO: 7797 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnggagacaanntttttttttttttttttttttttttttttt

SEQ ID NO: 7798 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntcaaggacnntttttttttttttttttttttttttttttt

SEQ ID NO: 7799 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnaagagagcnntttttttttttttttttttttttttttttt

SEQ ID NO: 7800 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncgagagatnntttttttttttttttttttttttttttttt

SEQ ID NO: 7801 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnacagatggnntttttttttttttttttttttttttttttt

SEQ ID NO: 7802 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnaggagtcanntttttttttttttttttttttttttttttt

SEQ ID NO: 7803 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncgtgttacnntttttttttttttttttttttttttttttt

SEQ ID NO: 7804 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntagtgtgcnntttttttttttttttttttttttttttttt

SEQ ID NO: 7805 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnctcatgacnntttttttttttttttttttttttttttttt

SEQ ID NO: 7806 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngtatccagnntttttttttttttttttttttttttttttt

SEQ ID NO: 7807 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnacgcctatnntttttttttttttttttttttttttttttt

SEQ ID NO: 7808 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnaacgacctnntttttttttttttttttttttttttttttt

SEQ ID NO: 7809 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnatcaggctnntttttttttttttttttttttttttttttt

SEQ ID NO: 7810 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncaagttcgnntttttttttttttttttttttttttttttt

SEQ ID NO: 7811 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntagccaganntttttttttttttttttttttttttttttt

SEQ ID NO: 7812 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncaatcacgnntttttttttttttttttttttttttttttt

SEQ ID NO: 7813 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnngcaacaagnntttttttttttttttttttttttttttttt

SEQ ID NO: 7814 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncacgacaanntttttttttttttttttttttttttttttt

SEQ ID NO: 7815 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntacggaganntttttttttttttttttttttttttttttt

SEQ ID NO: 7816 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncgacaaganntttttttttttttttttttttttttttttt

SEQ ID NO: 7817 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncgaagtganntttttttttttttttttttttttttttttt

SEQ ID NO: 7818 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnagctggtanntttttttttttttttttttttttttttttt

SEQ ID NO: 7819 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnaactaggcnntttttttttttttttttttttttttttttt

SEQ ID NO: 7820 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncagcaagtnntttttttttttttttttttttttttttttt

SEQ ID NO: 7821 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnacgaggtanntttttttttttttttttttttttttttttt

SEQ ID NO: 7822 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncatcttccnntttttttttttttttttttttttttttttt

SEQ ID NO: 7823 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncctgaatcnntttttttttttttttttttttttttttttt

SEQ ID NO: 7824 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnntgcagactnntttttttttttttttttttttttttttttt

SEQ ID NO: 7825 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnagatgtggnntttttttttttttttttttttttttttttt

SEQ ID NO: 7826 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnagttcgacnntttttttttttttttttttttttttttttt

SEQ ID NO: 7827 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnnacaacctcnntttttttttttttttttttttttttttttt

SEQ ID NO: 7828 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncatggtagnntttttttttttttttttttttttttttttt

SEQ ID NO: 7829 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncgtatctcnntttttttttttttttttttttttttttttt

SEQ ID NO: 7830 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncctagttcnntttttttttttttttttttttttttttttt

SEQ ID NO: 7831 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncctcatgtnncaagagtcnntttttttttttttttttttttttttttttt

SEQ ID NO: 7832 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnaatcggcanntttttttttttttttttttttttttttttt

SEQ ID NO: 7833 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntacggcatnntttttttttttttttttttttttttttttt

SEQ ID NO: 7834 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnttggatcgnntttttttttttttttttttttttttttttt

SEQ ID NO: 7835 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntggaacganntttttttttttttttttttttttttttttt

SEQ ID NO: 7836 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnggcaatcanntttttttttttttttttttttttttttttt

SEQ ID NO: 7837 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngaatccganntttttttttttttttttttttttttttttt

SEQ ID NO: 7838 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnttacggtgnntttttttttttttttttttttttttttttt

SEQ ID NO: 7839 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncatatcggnntttttttttttttttttttttttttttttt

SEQ ID NO: 7840 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncttcggtanntttttttttttttttttttttttttttttt

SEQ ID NO: 7841 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntcctaacgnntttttttttttttttttttttttttttttt

SEQ ID NO: 7842 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngtaagccanntttttttttttttttttttttttttttttt

SEQ ID NO: 7843 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntaaggtggnntttttttttttttttttttttttttttttt

SEQ ID NO: 7844 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnggtaagctnntttttttttttttttttttttttttttttt

SEQ ID NO: 7845 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntgtgtcganntttttttttttttttttttttttttttttt

SEQ ID NO: 7846 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngagcatganntttttttttttttttttttttttttttttt

SEQ ID NO: 7847 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntcgaagtcnntttttttttttttttttttttttttttttt

SEQ ID NO: 7848 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnggtgaacanntttttttttttttttttttttttttttttt

SEQ ID NO: 7849 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnacatgcacnntttttttttttttttttttttttttttttt

SEQ ID NO: 7850 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnccaacagtnntttttttttttttttttttttttttttttt

SEQ ID NO: 7851 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnagaacagcnntttttttttttttttttttttttttttttt

SEQ ID NO: 7852 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngaacacgtnntttttttttttttttttttttttttttttt

SEQ ID NO: 7853 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnggtcttcanntttttttttttttttttttttttttttttt

SEQ ID NO: 7854 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnaggttcagnntttttttttttttttttttttttttttttt

SEQ ID NO: 7855 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnctagagcanntttttttttttttttttttttttttttttt

SEQ ID NO: 7856 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncttctagcnntttttttttttttttttttttttttttttt

SEQ ID NO: 7857 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngagtaacgnntttttttttttttttttttttttttttttt

SEQ ID NO: 7858 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnctaagaggnntttttttttttttttttttttttttttttt

SEQ ID NO: 7859 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnacgtgtagnntttttttttttttttttttttttttttttt

SEQ ID NO: 7860 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnactacaggnntttttttttttttttttttttttttttttt

SEQ ID NO: 7861 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntacaggtcnntttttttttttttttttttttttttttttt

SEQ ID NO: 7862 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnctcacatgnntttttttttttttttttttttttttttttt

SEQ ID NO: 7863 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnactaggagnntttttttttttttttttttttttttttttt

SEQ ID NO: 7864 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnccatagganntttttttttttttttttttttttttttttt

SEQ ID NO: 7865 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnggagaatcnntttttttttttttttttttttttttttttt

SEQ ID NO: 7866 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngccaagaanntttttttttttttttttttttttttttttt

SEQ ID NO: 7867 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnaaggcaagnntttttttttttttttttttttttttttttt

SEQ ID NO: 7868 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnaatgtcgcnntttttttttttttttttttttttttttttt

SEQ ID NO: 7869 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnatggaaccnntttttttttttttttttttttttttttttt

SEQ ID NO: 7870 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnagaggcatnntttttttttttttttttttttttttttttt

SEQ ID NO: 7871 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntgcatagcnntttttttttttttttttttttttttttttt

SEQ ID NO: 7872 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnctaacgganntttttttttttttttttttttttttttttt

SEQ ID NO: 7873 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntatcgaggnntttttttttttttttttttttttttttttt

SEQ ID NO: 7874 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncatagcctnntttttttttttttttttttttttttttttt

SEQ ID NO: 7875 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnatcgagacnntttttttttttttttttttttttttttttt

SEQ ID NO: 7876 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnggaagagtnntttttttttttttttttttttttttttttt

SEQ ID NO: 7877 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnccaagtagnntttttttttttttttttttttttttttttt

SEQ ID NO: 7878 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnctgaacagnntttttttttttttttttttttttttttttt

SEQ ID NO: 7879 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngtaggttcnntttttttttttttttttttttttttttttt

SEQ ID NO: 7880 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngtatggacnntttttttttttttttttttttttttttttt

SEQ ID NO: 7881 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntcgcaacanntttttttttttttttttttttttttttttt

SEQ ID NO: 7882 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnccgctaatnntttttttttttttttttttttttttttttt

SEQ ID NO: 7883 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngattcgcanntttttttttttttttttttttttttttttt

SEQ ID NO: 7884 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncgatggaanntttttttttttttttttttttttttttttt

SEQ ID NO: 7885 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnagcaagganntttttttttttttttttttttttttttttt

SEQ ID NO: 7886 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncgtagcaanntttttttttttttttttttttttttttttt

SEQ ID NO: 7887 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntggcagtanntttttttttttttttttttttttttttttt

SEQ ID NO: 7888 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncggtagttnntttttttttttttttttttttttttttttt

SEQ ID NO: 7889 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntgacttcgnntttttttttttttttttttttttttttttt

SEQ ID NO: 7890 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngagtgcaanntttttttttttttttttttttttttttttt

SEQ ID NO: 7891 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnacggtaacnntttttttttttttttttttttttttttttt

SEQ ID NO: 7892 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnaagtggtgnntttttttttttttttttttttttttttttt

SEQ ID NO: 7893 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnggagacaanntttttttttttttttttttttttttttttt

SEQ ID NO: 7894 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntcaaggacnntttttttttttttttttttttttttttttt

SEQ ID NO: 7895 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnaagagagcnntttttttttttttttttttttttttttttt

SEQ ID NO: 7896 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncgagagatnntttttttttttttttttttttttttttttt

SEQ ID NO: 7897 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnacagatggnntttttttttttttttttttttttttttttt

SEQ ID NO: 7898 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnaggagtcanntttttttttttttttttttttttttttttt

SEQ ID NO: 7899 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncgtgttacnntttttttttttttttttttttttttttttt

SEQ ID NO: 7900 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntagtgtgcnntttttttttttttttttttttttttttttt

SEQ ID NO: 7901 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnctcatgacnntttttttttttttttttttttttttttttt

SEQ ID NO: 7902 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngtatccagnntttttttttttttttttttttttttttttt

SEQ ID NO: 7903 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnacgcctatnntttttttttttttttttttttttttttttt

SEQ ID NO: 7904 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnaacgacctnntttttttttttttttttttttttttttttt

SEQ ID NO: 7905 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnatcaggctnntttttttttttttttttttttttttttttt

SEQ ID NO: 7906 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncaagttcgnntttttttttttttttttttttttttttttt

SEQ ID NO: 7907 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntagccaganntttttttttttttttttttttttttttttt

SEQ ID NO: 7908 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncaatcacgnntttttttttttttttttttttttttttttt

SEQ ID NO: 7909 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnngcaacaagnntttttttttttttttttttttttttttttt

SEQ ID NO: 7910 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncacgacaanntttttttttttttttttttttttttttttt

SEQ ID NO: 7911 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntacggaganntttttttttttttttttttttttttttttt

SEQ ID NO: 7912 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncgacaaganntttttttttttttttttttttttttttttt

SEQ ID NO: 7913 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncgaagtganntttttttttttttttttttttttttttttt

SEQ ID NO: 7914 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnagctggtanntttttttttttttttttttttttttttttt

SEQ ID NO: 7915 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnaactaggcnntttttttttttttttttttttttttttttt

SEQ ID NO: 7916 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncagcaagtnntttttttttttttttttttttttttttttt

SEQ ID NO: 7917 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnacgaggtanntttttttttttttttttttttttttttttt

SEQ ID NO: 7918 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncatcttccnntttttttttttttttttttttttttttttt

SEQ ID NO: 7919 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncctgaatcnntttttttttttttttttttttttttttttt

SEQ ID NO: 7920 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnntgcagactnntttttttttttttttttttttttttttttt

SEQ ID NO: 7921 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnagatgtggnntttttttttttttttttttttttttttttt

SEQ ID NO: 7922 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnagttcgacnntttttttttttttttttttttttttttttt

SEQ ID NO: 7923 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnnacaacctcnntttttttttttttttttttttttttttttt

SEQ ID NO: 7924 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncatggtagnntttttttttttttttttttttttttttttt

SEQ ID NO: 7925 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncgtatctcnntttttttttttttttttttttttttttttt

SEQ ID NO: 7926 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncctagttcnntttttttttttttttttttttttttttttt

SEQ ID NO: 7927 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnggagtgttnncaagagtcnntttttttttttttttttttttttttttttt

SEQ ID NO: 7928 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnaatcggcanntttttttttttttttttttttttttttttt

SEQ ID NO: 7929 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntacggcatnntttttttttttttttttttttttttttttt

SEQ ID NO: 7930 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnttggatcgnntttttttttttttttttttttttttttttt

SEQ ID NO: 7931 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntggaacganntttttttttttttttttttttttttttttt

SEQ ID NO: 7932 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnggcaatcanntttttttttttttttttttttttttttttt

SEQ ID NO: 7933 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngaatccganntttttttttttttttttttttttttttttt

SEQ ID NO: 7934 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnttacggtgnntttttttttttttttttttttttttttttt

SEQ ID NO: 7935 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncatatcggnntttttttttttttttttttttttttttttt

SEQ ID NO: 7936 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncttcggtanntttttttttttttttttttttttttttttt

SEQ ID NO: 7937 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntcctaacgnntttttttttttttttttttttttttttttt

SEQ ID NO: 7938 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngtaagccanntttttttttttttttttttttttttttttt

SEQ ID NO: 7939 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntaaggtggnntttttttttttttttttttttttttttttt

SEQ ID NO: 7940 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnggtaagctnntttttttttttttttttttttttttttttt

SEQ ID NO: 7941 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntgtgtcganntttttttttttttttttttttttttttttt

SEQ ID NO: 7942 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngagcatganntttttttttttttttttttttttttttttt

SEQ ID NO: 7943 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntcgaagtcnntttttttttttttttttttttttttttttt

SEQ ID NO: 7944 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnggtgaacanntttttttttttttttttttttttttttttt

SEQ ID NO: 7945 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnacatgcacnntttttttttttttttttttttttttttttt

SEQ ID NO: 7946 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnccaacagtnntttttttttttttttttttttttttttttt

SEQ ID NO: 7947 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnagaacagcnntttttttttttttttttttttttttttttt

SEQ ID NO: 7948 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngaacacgtnntttttttttttttttttttttttttttttt

SEQ ID NO: 7949 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnggtcttcanntttttttttttttttttttttttttttttt

SEQ ID NO: 7950 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnaggttcagnntttttttttttttttttttttttttttttt

SEQ ID NO: 7951 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnctagagcanntttttttttttttttttttttttttttttt

SEQ ID NO: 7952 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncttctagcnntttttttttttttttttttttttttttttt

SEQ ID NO: 7953 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngagtaacgnntttttttttttttttttttttttttttttt

SEQ ID NO: 7954 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnctaagaggnntttttttttttttttttttttttttttttt

SEQ ID NO: 7955 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnacgtgtagnntttttttttttttttttttttttttttttt

SEQ ID NO: 7956 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnactacaggnntttttttttttttttttttttttttttttt

SEQ ID NO: 7957 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntacaggtcnntttttttttttttttttttttttttttttt

SEQ ID NO: 7958 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnctcacatgnntttttttttttttttttttttttttttttt

SEQ ID NO: 7959 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnactaggagnntttttttttttttttttttttttttttttt

SEQ ID NO: 7960 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnccatagganntttttttttttttttttttttttttttttt

SEQ ID NO: 7961 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnggagaatcnntttttttttttttttttttttttttttttt

SEQ ID NO: 7962 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngccaagaanntttttttttttttttttttttttttttttt

SEQ ID NO: 7963 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnaaggcaagnntttttttttttttttttttttttttttttt

SEQ ID NO: 7964 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnaatgtcgcnntttttttttttttttttttttttttttttt

SEQ ID NO: 7965 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnatggaaccnntttttttttttttttttttttttttttttt

SEQ ID NO: 7966 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnagaggcatnntttttttttttttttttttttttttttttt

SEQ ID NO: 7967 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntgcatagcnntttttttttttttttttttttttttttttt

SEQ ID NO: 7968 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnctaacgganntttttttttttttttttttttttttttttt

SEQ ID NO: 7969 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntatcgaggnntttttttttttttttttttttttttttttt

SEQ ID NO: 7970 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncatagcctnntttttttttttttttttttttttttttttt

SEQ ID NO: 7971 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnatcgagacnntttttttttttttttttttttttttttttt

SEQ ID NO: 7972 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnggaagagtnntttttttttttttttttttttttttttttt

SEQ ID NO: 7973 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnccaagtagnntttttttttttttttttttttttttttttt

SEQ ID NO: 7974 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnctgaacagnntttttttttttttttttttttttttttttt

SEQ ID NO: 7975 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngtaggttcnntttttttttttttttttttttttttttttt

SEQ ID NO: 7976 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngtatggacnntttttttttttttttttttttttttttttt

SEQ ID NO: 7977 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntcgcaacanntttttttttttttttttttttttttttttt

SEQ ID NO: 7978 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnccgctaatnntttttttttttttttttttttttttttttt

SEQ ID NO: 7979 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngattcgcanntttttttttttttttttttttttttttttt

SEQ ID NO: 7980 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncgatggaanntttttttttttttttttttttttttttttt

SEQ ID NO: 7981 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnagcaagganntttttttttttttttttttttttttttttt

SEQ ID NO: 7982 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncgtagcaanntttttttttttttttttttttttttttttt

SEQ ID NO: 7983 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntggcagtanntttttttttttttttttttttttttttttt

SEQ ID NO: 7984 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncggtagttnntttttttttttttttttttttttttttttt

SEQ ID NO: 7985 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntgacttcgnntttttttttttttttttttttttttttttt

SEQ ID NO: 7986 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngagtgcaanntttttttttttttttttttttttttttttt

SEQ ID NO: 7987 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnacggtaacnntttttttttttttttttttttttttttttt

SEQ ID NO: 7988 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnaagtggtgnntttttttttttttttttttttttttttttt

SEQ ID NO: 7989 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnggagacaanntttttttttttttttttttttttttttttt

SEQ ID NO: 7990 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntcaaggacnntttttttttttttttttttttttttttttt

SEQ ID NO: 7991 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnaagagagcnntttttttttttttttttttttttttttttt

SEQ ID NO: 7992 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncgagagatnntttttttttttttttttttttttttttttt

SEQ ID NO: 7993 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnacagatggnntttttttttttttttttttttttttttttt

SEQ ID NO: 7994 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnaggagtcanntttttttttttttttttttttttttttttt

SEQ ID NO: 7995 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncgtgttacnntttttttttttttttttttttttttttttt

SEQ ID NO: 7996 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntagtgtgcnntttttttttttttttttttttttttttttt

SEQ ID NO: 7997 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnctcatgacnntttttttttttttttttttttttttttttt

SEQ ID NO: 7998 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngtatccagnntttttttttttttttttttttttttttttt

SEQ ID NO: 7999 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnacgcctatnntttttttttttttttttttttttttttttt

SEQ ID NO: 8000 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnaacgacctnntttttttttttttttttttttttttttttt

SEQ ID NO: 8001 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnatcaggctnntttttttttttttttttttttttttttttt

SEQ ID NO: 8002 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncaagttcgnntttttttttttttttttttttttttttttt

SEQ ID NO: 8003 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntagccaganntttttttttttttttttttttttttttttt

SEQ ID NO: 8004 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncaatcacgnntttttttttttttttttttttttttttttt

SEQ ID NO: 8005 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnngcaacaagnntttttttttttttttttttttttttttttt

SEQ ID NO: 8006 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncacgacaanntttttttttttttttttttttttttttttt

SEQ ID NO: 8007 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntacggaganntttttttttttttttttttttttttttttt

SEQ ID NO: 8008 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncgacaaganntttttttttttttttttttttttttttttt

SEQ ID NO: 8009 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncgaagtganntttttttttttttttttttttttttttttt

SEQ ID NO: 8010 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnagctggtanntttttttttttttttttttttttttttttt

SEQ ID NO: 8011 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnaactaggcnntttttttttttttttttttttttttttttt

SEQ ID NO: 8012 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncagcaagtnntttttttttttttttttttttttttttttt

SEQ ID NO: 8013 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnacgaggtanntttttttttttttttttttttttttttttt

SEQ ID NO: 8014 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncatcttccnntttttttttttttttttttttttttttttt

SEQ ID NO: 8015 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncctgaatcnntttttttttttttttttttttttttttttt

SEQ ID NO: 8016 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnntgcagactnntttttttttttttttttttttttttttttt

SEQ ID NO: 8017 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnagatgtggnntttttttttttttttttttttttttttttt

SEQ ID NO: 8018 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnagttcgacnntttttttttttttttttttttttttttttt

SEQ ID NO: 8019 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnnacaacctcnntttttttttttttttttttttttttttttt

SEQ ID NO: 8020 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncatggtagnntttttttttttttttttttttttttttttt

SEQ ID NO: 8021 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncgtatctcnntttttttttttttttttttttttttttttt

SEQ ID NO: 8022 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncctagttcnntttttttttttttttttttttttttttttt

SEQ ID NO: 8023 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngaagatccnncaagagtcnntttttttttttttttttttttttttttttt

SEQ ID NO: 8024 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannaatcggcanntttttttttttttttttttttttttttttt

SEQ ID NO: 8025 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntacggcatnntttttttttttttttttttttttttttttt

SEQ ID NO: 8026 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannttggatcgnntttttttttttttttttttttttttttttt

SEQ ID NO: 8027 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntggaacganntttttttttttttttttttttttttttttt

SEQ ID NO: 8028 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannggcaatcanntttttttttttttttttttttttttttttt

SEQ ID NO: 8029 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngaatccganntttttttttttttttttttttttttttttt

SEQ ID NO: 8030 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannttacggtgnntttttttttttttttttttttttttttttt

SEQ ID NO: 8031 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncatatcggnntttttttttttttttttttttttttttttt

SEQ ID NO: 8032 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncttcggtanntttttttttttttttttttttttttttttt

SEQ ID NO: 8033 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntcctaacgnntttttttttttttttttttttttttttttt

SEQ ID NO: 8034 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngtaagccanntttttttttttttttttttttttttttttt

SEQ ID NO: 8035 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntaaggtggnntttttttttttttttttttttttttttttt

SEQ ID NO: 8036 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannggtaagctnntttttttttttttttttttttttttttttt

SEQ ID NO: 8037 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntgtgtcganntttttttttttttttttttttttttttttt

SEQ ID NO: 8038 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngagcatganntttttttttttttttttttttttttttttt

SEQ ID NO: 8039 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntcgaagtcnntttttttttttttttttttttttttttttt

SEQ ID NO: 8040 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannggtgaacanntttttttttttttttttttttttttttttt

SEQ ID NO: 8041 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannacatgcacnntttttttttttttttttttttttttttttt

SEQ ID NO: 8042 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannccaacagtnntttttttttttttttttttttttttttttt

SEQ ID NO: 8043 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannagaacagcnntttttttttttttttttttttttttttttt

SEQ ID NO: 8044 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngaacacgtnntttttttttttttttttttttttttttttt

SEQ ID NO: 8045 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannggtcttcanntttttttttttttttttttttttttttttt

SEQ ID NO: 8046 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannaggttcagnntttttttttttttttttttttttttttttt

SEQ ID NO: 8047 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannctagagcanntttttttttttttttttttttttttttttt

SEQ ID NO: 8048 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncttctagcnntttttttttttttttttttttttttttttt

SEQ ID NO: 8049 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngagtaacgnntttttttttttttttttttttttttttttt

SEQ ID NO: 8050 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannctaagaggnntttttttttttttttttttttttttttttt

SEQ ID NO: 8051 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannacgtgtagnntttttttttttttttttttttttttttttt

SEQ ID NO: 8052 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannactacaggnntttttttttttttttttttttttttttttt

SEQ ID NO: 8053 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntacaggtcnntttttttttttttttttttttttttttttt

SEQ ID NO: 8054 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannctcacatgnntttttttttttttttttttttttttttttt

SEQ ID NO: 8055 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannactaggagnntttttttttttttttttttttttttttttt

SEQ ID NO: 8056 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannccatagganntttttttttttttttttttttttttttttt

SEQ ID NO: 8057 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannggagaatcnntttttttttttttttttttttttttttttt

SEQ ID NO: 8058 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngccaagaanntttttttttttttttttttttttttttttt

SEQ ID NO: 8059 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannaaggcaagnntttttttttttttttttttttttttttttt

SEQ ID NO: 8060 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannaatgtcgcnntttttttttttttttttttttttttttttt

SEQ ID NO: 8061 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannatggaaccnntttttttttttttttttttttttttttttt

SEQ ID NO: 8062 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannagaggcatnntttttttttttttttttttttttttttttt

SEQ ID NO: 8063 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntgcatagcnntttttttttttttttttttttttttttttt

SEQ ID NO: 8064 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannctaacgganntttttttttttttttttttttttttttttt

SEQ ID NO: 8065 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntatcgaggnntttttttttttttttttttttttttttttt

SEQ ID NO: 8066 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncatagcctnntttttttttttttttttttttttttttttt

SEQ ID NO: 8067 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannatcgagacnntttttttttttttttttttttttttttttt

SEQ ID NO: 8068 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannggaagagtnntttttttttttttttttttttttttttttt

SEQ ID NO: 8069 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannccaagtagnntttttttttttttttttttttttttttttt

SEQ ID NO: 8070 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannctgaacagnntttttttttttttttttttttttttttttt

SEQ ID NO: 8071 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngtaggttcnntttttttttttttttttttttttttttttt

SEQ ID NO: 8072 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngtatggacnntttttttttttttttttttttttttttttt

SEQ ID NO: 8073 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntcgcaacanntttttttttttttttttttttttttttttt

SEQ ID NO: 8074 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannccgctaatnntttttttttttttttttttttttttttttt

SEQ ID NO: 8075 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngattcgcanntttttttttttttttttttttttttttttt

SEQ ID NO: 8076 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncgatggaanntttttttttttttttttttttttttttttt

SEQ ID NO: 8077 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannagcaagganntttttttttttttttttttttttttttttt

SEQ ID NO: 8078 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncgtagcaanntttttttttttttttttttttttttttttt

SEQ ID NO: 8079 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntggcagtanntttttttttttttttttttttttttttttt

SEQ ID NO: 8080 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncggtagttnntttttttttttttttttttttttttttttt

SEQ ID NO: 8081 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntgacttcgnntttttttttttttttttttttttttttttt

SEQ ID NO: 8082 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngagtgcaanntttttttttttttttttttttttttttttt

SEQ ID NO: 8083 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannacggtaacnntttttttttttttttttttttttttttttt

SEQ ID NO: 8084 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannaagtggtgnntttttttttttttttttttttttttttttt

SEQ ID NO: 8085 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannggagacaanntttttttttttttttttttttttttttttt

SEQ ID NO: 8086 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntcaaggacnntttttttttttttttttttttttttttttt

SEQ ID NO: 8087 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannaagagagcnntttttttttttttttttttttttttttttt

SEQ ID NO: 8088 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncgagagatnntttttttttttttttttttttttttttttt

SEQ ID NO: 8089 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannacagatggnntttttttttttttttttttttttttttttt

SEQ ID NO: 8090 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannaggagtcanntttttttttttttttttttttttttttttt

SEQ ID NO: 8091 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncgtgttacnntttttttttttttttttttttttttttttt

SEQ ID NO: 8092 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntagtgtgcnntttttttttttttttttttttttttttttt

SEQ ID NO: 8093 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannctcatgacnntttttttttttttttttttttttttttttt

SEQ ID NO: 8094 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngtatccagnntttttttttttttttttttttttttttttt

SEQ ID NO: 8095 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannacgcctatnntttttttttttttttttttttttttttttt

SEQ ID NO: 8096 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannaacgacctnntttttttttttttttttttttttttttttt

SEQ ID NO: 8097 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannatcaggctnntttttttttttttttttttttttttttttt

SEQ ID NO: 8098 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncaagttcgnntttttttttttttttttttttttttttttt

SEQ ID NO: 8099 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntagccaganntttttttttttttttttttttttttttttt

SEQ ID NO: 8100 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncaatcacgnntttttttttttttttttttttttttttttt

SEQ ID NO: 8101 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganngcaacaagnntttttttttttttttttttttttttttttt

SEQ ID NO: 8102 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncacgacaanntttttttttttttttttttttttttttttt

SEQ ID NO: 8103 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntacggaganntttttttttttttttttttttttttttttt

SEQ ID NO: 8104 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncgacaaganntttttttttttttttttttttttttttttt

SEQ ID NO: 8105 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncgaagtganntttttttttttttttttttttttttttttt

SEQ ID NO: 8106 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannagctggtanntttttttttttttttttttttttttttttt

SEQ ID NO: 8107 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannaactaggcnntttttttttttttttttttttttttttttt

SEQ ID NO: 8108 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncagcaagtnntttttttttttttttttttttttttttttt

SEQ ID NO: 8109 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannacgaggtanntttttttttttttttttttttttttttttt

SEQ ID NO: 8110 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncatcttccnntttttttttttttttttttttttttttttt

SEQ ID NO: 8111 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncctgaatcnntttttttttttttttttttttttttttttt

SEQ ID NO: 8112 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganntgcagactnntttttttttttttttttttttttttttttt

SEQ ID NO: 8113 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannagatgtggnntttttttttttttttttttttttttttttt

SEQ ID NO: 8114 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannagttcgacnntttttttttttttttttttttttttttttt

SEQ ID NO: 8115 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggagannacaacctcnntttttttttttttttttttttttttttttt

SEQ ID NO: 8116 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncatggtagnntttttttttttttttttttttttttttttt

SEQ ID NO: 8117 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncgtatctcnntttttttttttttttttttttttttttttt

SEQ ID NO: 8118 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncctagttcnntttttttttttttttttttttttttttttt

SEQ ID NO: 8119 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnagtggaganncaagagtcnntttttttttttttttttttttttttttttt

SEQ ID NO: 8120 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnaatcggcanntttttttttttttttttttttttttttttt

SEQ ID NO: 8121 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntacggcatnntttttttttttttttttttttttttttttt

SEQ ID NO: 8122 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnttggatcgnntttttttttttttttttttttttttttttt

SEQ ID NO: 8123 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntggaacganntttttttttttttttttttttttttttttt

SEQ ID NO: 8124 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnggcaatcanntttttttttttttttttttttttttttttt

SEQ ID NO: 8125 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngaatccganntttttttttttttttttttttttttttttt

SEQ ID NO: 8126 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnttacggtgnntttttttttttttttttttttttttttttt

SEQ ID NO: 8127 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncatatcggnntttttttttttttttttttttttttttttt

SEQ ID NO: 8128 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncttcggtanntttttttttttttttttttttttttttttt

SEQ ID NO: 8129 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntcctaacgnntttttttttttttttttttttttttttttt

SEQ ID NO: 8130 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngtaagccanntttttttttttttttttttttttttttttt

SEQ ID NO: 8131 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntaaggtggnntttttttttttttttttttttttttttttt

SEQ ID NO: 8132 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnggtaagctnntttttttttttttttttttttttttttttt

SEQ ID NO: 8133 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntgtgtcganntttttttttttttttttttttttttttttt

SEQ ID NO: 8134 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngagcatganntttttttttttttttttttttttttttttt

SEQ ID NO: 8135 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntcgaagtcnntttttttttttttttttttttttttttttt

SEQ ID NO: 8136 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnggtgaacanntttttttttttttttttttttttttttttt

SEQ ID NO: 8137 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnacatgcacnntttttttttttttttttttttttttttttt

SEQ ID NO: 8138 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnccaacagtnntttttttttttttttttttttttttttttt

SEQ ID NO: 8139 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnagaacagcnntttttttttttttttttttttttttttttt

SEQ ID NO: 8140 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngaacacgtnntttttttttttttttttttttttttttttt

SEQ ID NO: 8141 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnggtcttcanntttttttttttttttttttttttttttttt

SEQ ID NO: 8142 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnaggttcagnntttttttttttttttttttttttttttttt

SEQ ID NO: 8143 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnctagagcanntttttttttttttttttttttttttttttt

SEQ ID NO: 8144 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncttctagcnntttttttttttttttttttttttttttttt

SEQ ID NO: 8145 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngagtaacgnntttttttttttttttttttttttttttttt

SEQ ID NO: 8146 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnctaagaggnntttttttttttttttttttttttttttttt

SEQ ID NO: 8147 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnacgtgtagnntttttttttttttttttttttttttttttt

SEQ ID NO: 8148 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnactacaggnntttttttttttttttttttttttttttttt

SEQ ID NO: 8149 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntacaggtcnntttttttttttttttttttttttttttttt

SEQ ID NO: 8150 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnctcacatgnntttttttttttttttttttttttttttttt

SEQ ID NO: 8151 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnactaggagnntttttttttttttttttttttttttttttt

SEQ ID NO: 8152 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnccatagganntttttttttttttttttttttttttttttt

SEQ ID NO: 8153 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnggagaatcnntttttttttttttttttttttttttttttt

SEQ ID NO: 8154 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngccaagaanntttttttttttttttttttttttttttttt

SEQ ID NO: 8155 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnaaggcaagnntttttttttttttttttttttttttttttt

SEQ ID NO: 8156 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnaatgtcgcnntttttttttttttttttttttttttttttt

SEQ ID NO: 8157 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnatggaaccnntttttttttttttttttttttttttttttt

SEQ ID NO: 8158 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnagaggcatnntttttttttttttttttttttttttttttt

SEQ ID NO: 8159 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntgcatagcnntttttttttttttttttttttttttttttt

SEQ ID NO: 8160 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnctaacgganntttttttttttttttttttttttttttttt

SEQ ID NO: 8161 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntatcgaggnntttttttttttttttttttttttttttttt

SEQ ID NO: 8162 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncatagcctnntttttttttttttttttttttttttttttt

SEQ ID NO: 8163 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnatcgagacnntttttttttttttttttttttttttttttt

SEQ ID NO: 8164 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnggaagagtnntttttttttttttttttttttttttttttt

SEQ ID NO: 8165 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnccaagtagnntttttttttttttttttttttttttttttt

SEQ ID NO: 8166 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnctgaacagnntttttttttttttttttttttttttttttt

SEQ ID NO: 8167 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngtaggttcnntttttttttttttttttttttttttttttt

SEQ ID NO: 8168 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngtatggacnntttttttttttttttttttttttttttttt

SEQ ID NO: 8169 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntcgcaacanntttttttttttttttttttttttttttttt

SEQ ID NO: 8170 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnccgctaatnntttttttttttttttttttttttttttttt

SEQ ID NO: 8171 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngattcgcanntttttttttttttttttttttttttttttt

SEQ ID NO: 8172 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncgatggaanntttttttttttttttttttttttttttttt

SEQ ID NO: 8173 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnagcaagganntttttttttttttttttttttttttttttt

SEQ ID NO: 8174 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncgtagcaanntttttttttttttttttttttttttttttt

SEQ ID NO: 8175 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntggcagtanntttttttttttttttttttttttttttttt

SEQ ID NO: 8176 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncggtagttnntttttttttttttttttttttttttttttt

SEQ ID NO: 8177 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntgacttcgnntttttttttttttttttttttttttttttt

SEQ ID NO: 8178 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngagtgcaanntttttttttttttttttttttttttttttt

SEQ ID NO: 8179 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnacggtaacnntttttttttttttttttttttttttttttt

SEQ ID NO: 8180 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnaagtggtgnntttttttttttttttttttttttttttttt

SEQ ID NO: 8181 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnggagacaanntttttttttttttttttttttttttttttt

SEQ ID NO: 8182 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntcaaggacnntttttttttttttttttttttttttttttt

SEQ ID NO: 8183 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnaagagagcnntttttttttttttttttttttttttttttt

SEQ ID NO: 8184 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncgagagatnntttttttttttttttttttttttttttttt

SEQ ID NO: 8185 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnacagatggnntttttttttttttttttttttttttttttt

SEQ ID NO: 8186 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnaggagtcanntttttttttttttttttttttttttttttt

SEQ ID NO: 8187 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncgtgttacnntttttttttttttttttttttttttttttt

SEQ ID NO: 8188 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntagtgtgcnntttttttttttttttttttttttttttttt

SEQ ID NO: 8189 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnctcatgacnntttttttttttttttttttttttttttttt

SEQ ID NO: 8190 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngtatccagnntttttttttttttttttttttttttttttt

SEQ ID NO: 8191 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnacgcctatnntttttttttttttttttttttttttttttt

SEQ ID NO: 8192 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnaacgacctnntttttttttttttttttttttttttttttt

SEQ ID NO: 8193 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnatcaggctnntttttttttttttttttttttttttttttt

SEQ ID NO: 8194 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncaagttcgnntttttttttttttttttttttttttttttt

SEQ ID NO: 8195 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntagccaganntttttttttttttttttttttttttttttt

SEQ ID NO: 8196 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncaatcacgnntttttttttttttttttttttttttttttt

SEQ ID NO: 8197 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnngcaacaagnntttttttttttttttttttttttttttttt

SEQ ID NO: 8198 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncacgacaanntttttttttttttttttttttttttttttt

SEQ ID NO: 8199 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntacggaganntttttttttttttttttttttttttttttt

SEQ ID NO: 8200 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncgacaaganntttttttttttttttttttttttttttttt

SEQ ID NO: 8201 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncgaagtganntttttttttttttttttttttttttttttt

SEQ ID NO: 8202 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnagctggtanntttttttttttttttttttttttttttttt

SEQ ID NO: 8203 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnaactaggcnntttttttttttttttttttttttttttttt

SEQ ID NO: 8204 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncagcaagtnntttttttttttttttttttttttttttttt

SEQ ID NO: 8205 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnacgaggtanntttttttttttttttttttttttttttttt

SEQ ID NO: 8206 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncatcttccnntttttttttttttttttttttttttttttt

SEQ ID NO: 8207 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncctgaatcnntttttttttttttttttttttttttttttt

SEQ ID NO: 8208 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnntgcagactnntttttttttttttttttttttttttttttt

SEQ ID NO: 8209 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnagatgtggnntttttttttttttttttttttttttttttt

SEQ ID NO: 8210 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnagttcgacnntttttttttttttttttttttttttttttt

SEQ ID NO: 8211 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnnacaacctcnntttttttttttttttttttttttttttttt

SEQ ID NO: 8212 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncatggtagnntttttttttttttttttttttttttttttt

SEQ ID NO: 8213 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncgtatctcnntttttttttttttttttttttttttttttt

SEQ ID NO: 8214 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncctagttcnntttttttttttttttttttttttttttttt

SEQ ID NO: 8215 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagtagccnncaagagtcnntttttttttttttttttttttttttttttt

SEQ ID NO: 8216 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnaatcggcanntttttttttttttttttttttttttttttt

SEQ ID NO: 8217 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntacggcatnntttttttttttttttttttttttttttttt

SEQ ID NO: 8218 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnttggatcgnntttttttttttttttttttttttttttttt

SEQ ID NO: 8219 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntggaacganntttttttttttttttttttttttttttttt

SEQ ID NO: 8220 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnggcaatcanntttttttttttttttttttttttttttttt

SEQ ID NO: 8221 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngaatccganntttttttttttttttttttttttttttttt

SEQ ID NO: 8222 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnttacggtgnntttttttttttttttttttttttttttttt

SEQ ID NO: 8223 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncatatcggnntttttttttttttttttttttttttttttt

SEQ ID NO: 8224 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncttcggtanntttttttttttttttttttttttttttttt

SEQ ID NO: 8225 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntcctaacgnntttttttttttttttttttttttttttttt

SEQ ID NO: 8226 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngtaagccanntttttttttttttttttttttttttttttt

SEQ ID NO: 8227 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntaaggtggnntttttttttttttttttttttttttttttt

SEQ ID NO: 8228 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnggtaagctnntttttttttttttttttttttttttttttt

SEQ ID NO: 8229 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntgtgtcganntttttttttttttttttttttttttttttt

SEQ ID NO: 8230 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngagcatganntttttttttttttttttttttttttttttt

SEQ ID NO: 8231 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntcgaagtcnntttttttttttttttttttttttttttttt

SEQ ID NO: 8232 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnggtgaacanntttttttttttttttttttttttttttttt

SEQ ID NO: 8233 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnacatgcacnntttttttttttttttttttttttttttttt

SEQ ID NO: 8234 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnccaacagtnntttttttttttttttttttttttttttttt

SEQ ID NO: 8235 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnagaacagcnntttttttttttttttttttttttttttttt

SEQ ID NO: 8236 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngaacacgtnntttttttttttttttttttttttttttttt

SEQ ID NO: 8237 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnggtcttcanntttttttttttttttttttttttttttttt

SEQ ID NO: 8238 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnaggttcagnntttttttttttttttttttttttttttttt

SEQ ID NO: 8239 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnctagagcanntttttttttttttttttttttttttttttt

SEQ ID NO: 8240 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncttctagcnntttttttttttttttttttttttttttttt

SEQ ID NO: 8241 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngagtaacgnntttttttttttttttttttttttttttttt

SEQ ID NO: 8242 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnctaagaggnntttttttttttttttttttttttttttttt

SEQ ID NO: 8243 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnacgtgtagnntttttttttttttttttttttttttttttt

SEQ ID NO: 8244 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnactacaggnntttttttttttttttttttttttttttttt

SEQ ID NO: 8245 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntacaggtcnntttttttttttttttttttttttttttttt

SEQ ID NO: 8246 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnctcacatgnntttttttttttttttttttttttttttttt

SEQ ID NO: 8247 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnactaggagnntttttttttttttttttttttttttttttt

SEQ ID NO: 8248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnccatagganntttttttttttttttttttttttttttttt

SEQ ID NO: 8249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnggagaatcnntttttttttttttttttttttttttttttt

SEQ ID NO: 8250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngccaagaanntttttttttttttttttttttttttttttt

SEQ ID NO: 8251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnaaggcaagnntttttttttttttttttttttttttttttt

SEQ ID NO: 8252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnaatgtcgcnntttttttttttttttttttttttttttttt

SEQ ID NO: 8253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnatggaaccnntttttttttttttttttttttttttttttt

SEQ ID NO: 8254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnagaggcatnntttttttttttttttttttttttttttttt

SEQ ID NO: 8255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntgcatagcnntttttttttttttttttttttttttttttt

SEQ ID NO: 8256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnctaacgganntttttttttttttttttttttttttttttt

SEQ ID NO: 8257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntatcgaggnntttttttttttttttttttttttttttttt

SEQ ID NO: 8258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncatagcctnntttttttttttttttttttttttttttttt

SEQ ID NO: 8259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnatcgagacnntttttttttttttttttttttttttttttt

SEQ ID NO: 8260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnggaagagtnntttttttttttttttttttttttttttttt

SEQ ID NO: 8261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnccaagtagnntttttttttttttttttttttttttttttt

SEQ ID NO: 8262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnctgaacagnntttttttttttttttttttttttttttttt

SEQ ID NO: 8263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngtaggttcnntttttttttttttttttttttttttttttt

SEQ ID NO: 8264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngtatggacnntttttttttttttttttttttttttttttt

SEQ ID NO: 8265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntcgcaacanntttttttttttttttttttttttttttttt

SEQ ID NO: 8266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnccgctaatnntttttttttttttttttttttttttttttt

SEQ ID NO: 8267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngattcgcanntttttttttttttttttttttttttttttt

SEQ ID NO: 8268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncgatggaanntttttttttttttttttttttttttttttt

SEQ ID NO: 8269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnagcaagganntttttttttttttttttttttttttttttt

SEQ ID NO: 8270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncgtagcaanntttttttttttttttttttttttttttttt

SEQ ID NO: 8271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntggcagtanntttttttttttttttttttttttttttttt

SEQ ID NO: 8272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncggtagttnntttttttttttttttttttttttttttttt

SEQ ID NO: 8273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntgacttcgnntttttttttttttttttttttttttttttt

SEQ ID NO: 8274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngagtgcaanntttttttttttttttttttttttttttttt

SEQ ID NO: 8275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnacggtaacnntttttttttttttttttttttttttttttt

SEQ ID NO: 8276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnaagtggtgnntttttttttttttttttttttttttttttt

SEQ ID NO: 8277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnggagacaanntttttttttttttttttttttttttttttt

SEQ ID NO: 8278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntcaaggacnntttttttttttttttttttttttttttttt

SEQ ID NO: 8279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnaagagagcnntttttttttttttttttttttttttttttt

SEQ ID NO: 8280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncgagagatnntttttttttttttttttttttttttttttt

SEQ ID NO: 8281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnacagatggnntttttttttttttttttttttttttttttt

SEQ ID NO: 8282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnaggagtcanntttttttttttttttttttttttttttttt

SEQ ID NO: 8283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncgtgttacnntttttttttttttttttttttttttttttt

SEQ ID NO: 8284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntagtgtgcnntttttttttttttttttttttttttttttt

SEQ ID NO: 8285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnctcatgacnntttttttttttttttttttttttttttttt

SEQ ID NO: 8286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngtatccagnntttttttttttttttttttttttttttttt

SEQ ID NO: 8287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnacgcctatnntttttttttttttttttttttttttttttt

SEQ ID NO: 8288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnaacgacctnntttttttttttttttttttttttttttttt

SEQ ID NO: 8289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnatcaggctnntttttttttttttttttttttttttttttt

SEQ ID NO: 8290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncaagttcgnntttttttttttttttttttttttttttttt

SEQ ID NO: 8291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntagccaganntttttttttttttttttttttttttttttt

SEQ ID NO: 8292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncaatcacgnntttttttttttttttttttttttttttttt

SEQ ID NO: 8293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnngcaacaagnntttttttttttttttttttttttttttttt

SEQ ID NO: 8294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncacgacaanntttttttttttttttttttttttttttttt

SEQ ID NO: 8295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntacggaganntttttttttttttttttttttttttttttt

SEQ ID NO: 8296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncgacaaganntttttttttttttttttttttttttttttt

SEQ ID NO: 8297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncgaagtganntttttttttttttttttttttttttttttt

SEQ ID NO: 8298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnagctggtanntttttttttttttttttttttttttttttt

SEQ ID NO: 8299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnaactaggcnntttttttttttttttttttttttttttttt

SEQ ID NO: 8300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncagcaagtnntttttttttttttttttttttttttttttt

SEQ ID NO: 8301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnacgaggtanntttttttttttttttttttttttttttttt

SEQ ID NO: 8302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncatcttccnntttttttttttttttttttttttttttttt

SEQ ID NO: 8303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncctgaatcnntttttttttttttttttttttttttttttt

SEQ ID NO: 8304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnntgcagactnntttttttttttttttttttttttttttttt

SEQ ID NO: 8305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnagatgtggnntttttttttttttttttttttttttttttt

SEQ ID NO: 8306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnagttcgacnntttttttttttttttttttttttttttttt

SEQ ID NO: 8307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnnacaacctcnntttttttttttttttttttttttttttttt

SEQ ID NO: 8308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncatggtagnntttttttttttttttttttttttttttttt

SEQ ID NO: 8309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncgtatctcnntttttttttttttttttttttttttttttt

SEQ ID NO: 8310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncctagttcnntttttttttttttttttttttttttttttt

SEQ ID NO: 8311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngagatcagnncaagagtcnntttttttttttttttttttttttttttttt

SEQ ID NO: 8312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannaatcggcanntttttttttttttttttttttttttttttt

SEQ ID NO: 8313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntacggcatnntttttttttttttttttttttttttttttt

SEQ ID NO: 8314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannttggatcgnntttttttttttttttttttttttttttttt

SEQ ID NO: 8315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntggaacganntttttttttttttttttttttttttttttt

SEQ ID NO: 8316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannggcaatcanntttttttttttttttttttttttttttttt

SEQ ID NO: 8317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngaatccganntttttttttttttttttttttttttttttt

SEQ ID NO: 8318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannttacggtgnntttttttttttttttttttttttttttttt

SEQ ID NO: 8319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncatatcggnntttttttttttttttttttttttttttttt

SEQ ID NO: 8320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncttcggtanntttttttttttttttttttttttttttttt

SEQ ID NO: 8321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntcctaacgnntttttttttttttttttttttttttttttt

SEQ ID NO: 8322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngtaagccanntttttttttttttttttttttttttttttt

SEQ ID NO: 8323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntaaggtggnntttttttttttttttttttttttttttttt

SEQ ID NO: 8324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannggtaagctnntttttttttttttttttttttttttttttt

SEQ ID NO: 8325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntgtgtcganntttttttttttttttttttttttttttttt

SEQ ID NO: 8326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngagcatganntttttttttttttttttttttttttttttt

SEQ ID NO: 8327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntcgaagtcnntttttttttttttttttttttttttttttt

SEQ ID NO: 8328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannggtgaacanntttttttttttttttttttttttttttttt

SEQ ID NO: 8329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannacatgcacnntttttttttttttttttttttttttttttt

SEQ ID NO: 8330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannccaacagtnntttttttttttttttttttttttttttttt

SEQ ID NO: 8331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannagaacagcnntttttttttttttttttttttttttttttt

SEQ ID NO: 8332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngaacacgtnntttttttttttttttttttttttttttttt

SEQ ID NO: 8333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannggtcttcanntttttttttttttttttttttttttttttt

SEQ ID NO: 8334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannaggttcagnntttttttttttttttttttttttttttttt

SEQ ID NO: 8335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannctagagcanntttttttttttttttttttttttttttttt

SEQ ID NO: 8336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncttctagcnntttttttttttttttttttttttttttttt

SEQ ID NO: 8337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngagtaacgnntttttttttttttttttttttttttttttt

SEQ ID NO: 8338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannctaagaggnntttttttttttttttttttttttttttttt

SEQ ID NO: 8339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannacgtgtagnntttttttttttttttttttttttttttttt

SEQ ID NO: 8340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannactacaggnntttttttttttttttttttttttttttttt

SEQ ID NO: 8341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntacaggtcnntttttttttttttttttttttttttttttt

SEQ ID NO: 8342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannctcacatgnntttttttttttttttttttttttttttttt

SEQ ID NO: 8343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannactaggagnntttttttttttttttttttttttttttttt

SEQ ID NO: 8344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannccatagganntttttttttttttttttttttttttttttt

SEQ ID NO: 8345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannggagaatcnntttttttttttttttttttttttttttttt

SEQ ID NO: 8346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngccaagaanntttttttttttttttttttttttttttttt

SEQ ID NO: 8347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannaaggcaagnntttttttttttttttttttttttttttttt

SEQ ID NO: 8348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannaatgtcgcnntttttttttttttttttttttttttttttt

SEQ ID NO: 8349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannatggaaccnntttttttttttttttttttttttttttttt

SEQ ID NO: 8350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannagaggcatnntttttttttttttttttttttttttttttt

SEQ ID NO: 8351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntgcatagcnntttttttttttttttttttttttttttttt

SEQ ID NO: 8352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannctaacgganntttttttttttttttttttttttttttttt

SEQ ID NO: 8353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntatcgaggnntttttttttttttttttttttttttttttt

SEQ ID NO: 8354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncatagcctnntttttttttttttttttttttttttttttt

SEQ ID NO: 8355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannatcgagacnntttttttttttttttttttttttttttttt

SEQ ID NO: 8356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannggaagagtnntttttttttttttttttttttttttttttt

SEQ ID NO: 8357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannccaagtagnntttttttttttttttttttttttttttttt

SEQ ID NO: 8358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannctgaacagnntttttttttttttttttttttttttttttt

SEQ ID NO: 8359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngtaggttcnntttttttttttttttttttttttttttttt

SEQ ID NO: 8360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngtatggacnntttttttttttttttttttttttttttttt

SEQ ID NO: 8361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntcgcaacanntttttttttttttttttttttttttttttt

SEQ ID NO: 8362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannccgctaatnntttttttttttttttttttttttttttttt

SEQ ID NO: 8363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngattcgcanntttttttttttttttttttttttttttttt

SEQ ID NO: 8364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncgatggaanntttttttttttttttttttttttttttttt

SEQ ID NO: 8365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannagcaagganntttttttttttttttttttttttttttttt

SEQ ID NO: 8366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncgtagcaanntttttttttttttttttttttttttttttt

SEQ ID NO: 8367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntggcagtanntttttttttttttttttttttttttttttt

SEQ ID NO: 8368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncggtagttnntttttttttttttttttttttttttttttt

SEQ ID NO: 8369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntgacttcgnntttttttttttttttttttttttttttttt

SEQ ID NO: 8370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngagtgcaanntttttttttttttttttttttttttttttt

SEQ ID NO: 8371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannacggtaacnntttttttttttttttttttttttttttttt

SEQ ID NO: 8372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannaagtggtgnntttttttttttttttttttttttttttttt

SEQ ID NO: 8373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannggagacaanntttttttttttttttttttttttttttttt

SEQ ID NO: 8374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntcaaggacnntttttttttttttttttttttttttttttt

SEQ ID NO: 8375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannaagagagcnntttttttttttttttttttttttttttttt

SEQ ID NO: 8376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncgagagatnntttttttttttttttttttttttttttttt

SEQ ID NO: 8377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannacagatggnntttttttttttttttttttttttttttttt

SEQ ID NO: 8378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannaggagtcanntttttttttttttttttttttttttttttt

SEQ ID NO: 8379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncgtgttacnntttttttttttttttttttttttttttttt

SEQ ID NO: 8380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntagtgtgcnntttttttttttttttttttttttttttttt

SEQ ID NO: 8381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannctcatgacnntttttttttttttttttttttttttttttt

SEQ ID NO: 8382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngtatccagnntttttttttttttttttttttttttttttt

SEQ ID NO: 8383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannacgcctatnntttttttttttttttttttttttttttttt

SEQ ID NO: 8384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannaacgacctnntttttttttttttttttttttttttttttt

SEQ ID NO: 8385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannatcaggctnntttttttttttttttttttttttttttttt

SEQ ID NO: 8386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncaagttcgnntttttttttttttttttttttttttttttt

SEQ ID NO: 8387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntagccaganntttttttttttttttttttttttttttttt

SEQ ID NO: 8388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncaatcacgnntttttttttttttttttttttttttttttt

SEQ ID NO: 8389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanngcaacaagnntttttttttttttttttttttttttttttt

SEQ ID NO: 8390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncacgacaanntttttttttttttttttttttttttttttt

SEQ ID NO: 8391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntacggaganntttttttttttttttttttttttttttttt

SEQ ID NO: 8392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncgacaaganntttttttttttttttttttttttttttttt

SEQ ID NO: 8393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncgaagtganntttttttttttttttttttttttttttttt

SEQ ID NO: 8394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannagctggtanntttttttttttttttttttttttttttttt

SEQ ID NO: 8395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannaactaggcnntttttttttttttttttttttttttttttt

SEQ ID NO: 8396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncagcaagtnntttttttttttttttttttttttttttttt

SEQ ID NO: 8397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannacgaggtanntttttttttttttttttttttttttttttt

SEQ ID NO: 8398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncatcttccnntttttttttttttttttttttttttttttt

SEQ ID NO: 8399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncctgaatcnntttttttttttttttttttttttttttttt

SEQ ID NO: 8400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanntgcagactnntttttttttttttttttttttttttttttt

SEQ ID NO: 8401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannagatgtggnntttttttttttttttttttttttttttttt

SEQ ID NO: 8402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannagttcgacnntttttttttttttttttttttttttttttt

SEQ ID NO: 8403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcannacaacctcnntttttttttttttttttttttttttttttt

SEQ ID NO: 8404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncatggtagnntttttttttttttttttttttttttttttt

SEQ ID NO: 8405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncgtatctcnntttttttttttttttttttttttttttttt

SEQ ID NO: 8406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncctagttcnntttttttttttttttttttttttttttttt

SEQ ID NO: 8407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntgaaggcanncaagagtcnntttttttttttttttttttttttttttttt

SEQ ID NO: 8408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannaatcggcanntttttttttttttttttttttttttttttt

SEQ ID NO: 8409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntacggcatnntttttttttttttttttttttttttttttt

SEQ ID NO: 8410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannttggatcgnntttttttttttttttttttttttttttttt

SEQ ID NO: 8411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntggaacganntttttttttttttttttttttttttttttt

SEQ ID NO: 8412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannggcaatcanntttttttttttttttttttttttttttttt

SEQ ID NO: 8413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngaatccganntttttttttttttttttttttttttttttt

SEQ ID NO: 8414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannttacggtgnntttttttttttttttttttttttttttttt

SEQ ID NO: 8415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncatatcggnntttttttttttttttttttttttttttttt

SEQ ID NO: 8416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncttcggtanntttttttttttttttttttttttttttttt

SEQ ID NO: 8417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntcctaacgnntttttttttttttttttttttttttttttt

SEQ ID NO: 8418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngtaagccanntttttttttttttttttttttttttttttt

SEQ ID NO: 8419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntaaggtggnntttttttttttttttttttttttttttttt

SEQ ID NO: 8420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannggtaagctnntttttttttttttttttttttttttttttt

SEQ ID NO: 8421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntgtgtcganntttttttttttttttttttttttttttttt

SEQ ID NO: 8422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngagcatganntttttttttttttttttttttttttttttt

SEQ ID NO: 8423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntcgaagtcnntttttttttttttttttttttttttttttt

SEQ ID NO: 8424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannggtgaacanntttttttttttttttttttttttttttttt

SEQ ID NO: 8425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannacatgcacnntttttttttttttttttttttttttttttt

SEQ ID NO: 8426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannccaacagtnntttttttttttttttttttttttttttttt

SEQ ID NO: 8427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannagaacagcnntttttttttttttttttttttttttttttt

SEQ ID NO: 8428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngaacacgtnntttttttttttttttttttttttttttttt

SEQ ID NO: 8429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannggtcttcanntttttttttttttttttttttttttttttt

SEQ ID NO: 8430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannaggttcagnntttttttttttttttttttttttttttttt

SEQ ID NO: 8431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannctagagcanntttttttttttttttttttttttttttttt

SEQ ID NO: 8432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncttctagcnntttttttttttttttttttttttttttttt

SEQ ID NO: 8433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngagtaacgnntttttttttttttttttttttttttttttt

SEQ ID NO: 8434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannctaagaggnntttttttttttttttttttttttttttttt

SEQ ID NO: 8435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannacgtgtagnntttttttttttttttttttttttttttttt

SEQ ID NO: 8436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannactacaggnntttttttttttttttttttttttttttttt

SEQ ID NO: 8437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntacaggtcnntttttttttttttttttttttttttttttt

SEQ ID NO: 8438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannctcacatgnntttttttttttttttttttttttttttttt

SEQ ID NO: 8439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannactaggagnntttttttttttttttttttttttttttttt

SEQ ID NO: 8440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannccatagganntttttttttttttttttttttttttttttt

SEQ ID NO: 8441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannggagaatcnntttttttttttttttttttttttttttttt

SEQ ID NO: 8442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngccaagaanntttttttttttttttttttttttttttttt

SEQ ID NO: 8443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannaaggcaagnntttttttttttttttttttttttttttttt

SEQ ID NO: 8444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannaatgtcgcnntttttttttttttttttttttttttttttt

SEQ ID NO: 8445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannatggaaccnntttttttttttttttttttttttttttttt

SEQ ID NO: 8446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannagaggcatnntttttttttttttttttttttttttttttt

SEQ ID NO: 8447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntgcatagcnntttttttttttttttttttttttttttttt

SEQ ID NO: 8448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannctaacgganntttttttttttttttttttttttttttttt

SEQ ID NO: 8449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntatcgaggnntttttttttttttttttttttttttttttt

SEQ ID NO: 8450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncatagcctnntttttttttttttttttttttttttttttt

SEQ ID NO: 8451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannatcgagacnntttttttttttttttttttttttttttttt

SEQ ID NO: 8452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannggaagagtnntttttttttttttttttttttttttttttt

SEQ ID NO: 8453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannccaagtagnntttttttttttttttttttttttttttttt

SEQ ID NO: 8454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannctgaacagnntttttttttttttttttttttttttttttt

SEQ ID NO: 8455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngtaggttcnntttttttttttttttttttttttttttttt

SEQ ID NO: 8456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngtatggacnntttttttttttttttttttttttttttttt

SEQ ID NO: 8457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntcgcaacanntttttttttttttttttttttttttttttt

SEQ ID NO: 8458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannccgctaatnntttttttttttttttttttttttttttttt

SEQ ID NO: 8459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngattcgcanntttttttttttttttttttttttttttttt

SEQ ID NO: 8460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncgatggaanntttttttttttttttttttttttttttttt

SEQ ID NO: 8461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannagcaagganntttttttttttttttttttttttttttttt

SEQ ID NO: 8462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncgtagcaanntttttttttttttttttttttttttttttt

SEQ ID NO: 8463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntggcagtanntttttttttttttttttttttttttttttt

SEQ ID NO: 8464 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncggtagttnntttttttttttttttttttttttttttttt

SEQ ID NO: 8465 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntgacttcgnntttttttttttttttttttttttttttttt

SEQ ID NO: 8466 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngagtgcaanntttttttttttttttttttttttttttttt

SEQ ID NO: 8467 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannacggtaacnntttttttttttttttttttttttttttttt

SEQ ID NO: 8468 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannaagtggtgnntttttttttttttttttttttttttttttt

SEQ ID NO: 8469 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannggagacaanntttttttttttttttttttttttttttttt

SEQ ID NO: 8470 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntcaaggacnntttttttttttttttttttttttttttttt

SEQ ID NO: 8471 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannaagagagcnntttttttttttttttttttttttttttttt

SEQ ID NO: 8472 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncgagagatnntttttttttttttttttttttttttttttt

SEQ ID NO: 8473 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannacagatggnntttttttttttttttttttttttttttttt

SEQ ID NO: 8474 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannaggagtcanntttttttttttttttttttttttttttttt

SEQ ID NO: 8475 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncgtgttacnntttttttttttttttttttttttttttttt

SEQ ID NO: 8476 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntagtgtgcnntttttttttttttttttttttttttttttt

SEQ ID NO: 8477 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannctcatgacnntttttttttttttttttttttttttttttt

SEQ ID NO: 8478 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngtatccagnntttttttttttttttttttttttttttttt

SEQ ID NO: 8479 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannacgcctatnntttttttttttttttttttttttttttttt

SEQ ID NO: 8480 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannaacgacctnntttttttttttttttttttttttttttttt

SEQ ID NO: 8481 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannatcaggctnntttttttttttttttttttttttttttttt

SEQ ID NO: 8482 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncaagttcgnntttttttttttttttttttttttttttttt

SEQ ID NO: 8483 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntagccaganntttttttttttttttttttttttttttttt

SEQ ID NO: 8484 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncaatcacgnntttttttttttttttttttttttttttttt

SEQ ID NO: 8485 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganngcaacaagnntttttttttttttttttttttttttttttt

SEQ ID NO: 8486 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncacgacaanntttttttttttttttttttttttttttttt

SEQ ID NO: 8487 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntacggaganntttttttttttttttttttttttttttttt

SEQ ID NO: 8488 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncgacaaganntttttttttttttttttttttttttttttt

SEQ ID NO: 8489 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncgaagtganntttttttttttttttttttttttttttttt

SEQ ID NO: 8490 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannagctggtanntttttttttttttttttttttttttttttt

SEQ ID NO: 8491 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannaactaggcnntttttttttttttttttttttttttttttt

SEQ ID NO: 8492 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncagcaagtnntttttttttttttttttttttttttttttt

SEQ ID NO: 8493 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannacgaggtanntttttttttttttttttttttttttttttt

SEQ ID NO: 8494 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncatcttccnntttttttttttttttttttttttttttttt

SEQ ID NO: 8495 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncctgaatcnntttttttttttttttttttttttttttttt

SEQ ID NO: 8496 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganntgcagactnntttttttttttttttttttttttttttttt

SEQ ID NO: 8497 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannagatgtggnntttttttttttttttttttttttttttttt

SEQ ID NO: 8498 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannagttcgacnntttttttttttttttttttttttttttttt

SEQ ID NO: 8499 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatgannacaacctcnntttttttttttttttttttttttttttttt

SEQ ID NO: 8500 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncatggtagnntttttttttttttttttttttttttttttt

SEQ ID NO: 8501 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncgtatctcnntttttttttttttttttttttttttttttt

SEQ ID NO: 8502 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncctagttcnntttttttttttttttttttttttttttttt

SEQ ID NO: 8503 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntccgatganncaagagtcnntttttttttttttttttttttttttttttt

SEQ ID NO: 8504 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnaatcggcanntttttttttttttttttttttttttttttt

SEQ ID NO: 8505 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntacggcatnntttttttttttttttttttttttttttttt

SEQ ID NO: 8506 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnttggatcgnntttttttttttttttttttttttttttttt

SEQ ID NO: 8507 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntggaacganntttttttttttttttttttttttttttttt

SEQ ID NO: 8508 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnggcaatcanntttttttttttttttttttttttttttttt

SEQ ID NO: 8509 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngaatccganntttttttttttttttttttttttttttttt

SEQ ID NO: 8510 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnttacggtgnntttttttttttttttttttttttttttttt

SEQ ID NO: 8511 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncatatcggnntttttttttttttttttttttttttttttt

SEQ ID NO: 8512 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncttcggtanntttttttttttttttttttttttttttttt

SEQ ID NO: 8513 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntcctaacgnntttttttttttttttttttttttttttttt

SEQ ID NO: 8514 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngtaagccanntttttttttttttttttttttttttttttt

SEQ ID NO: 8515 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntaaggtggnntttttttttttttttttttttttttttttt

SEQ ID NO: 8516 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnggtaagctnntttttttttttttttttttttttttttttt

SEQ ID NO: 8517 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntgtgtcganntttttttttttttttttttttttttttttt

SEQ ID NO: 8518 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngagcatganntttttttttttttttttttttttttttttt

SEQ ID NO: 8519 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntcgaagtcnntttttttttttttttttttttttttttttt

SEQ ID NO: 8520 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnggtgaacanntttttttttttttttttttttttttttttt

SEQ ID NO: 8521 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnacatgcacnntttttttttttttttttttttttttttttt

SEQ ID NO: 8522 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnccaacagtnntttttttttttttttttttttttttttttt

SEQ ID NO: 8523 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnagaacagcnntttttttttttttttttttttttttttttt

SEQ ID NO: 8524 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngaacacgtnntttttttttttttttttttttttttttttt

SEQ ID NO: 8525 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnggtcttcanntttttttttttttttttttttttttttttt

SEQ ID NO: 8526 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnaggttcagnntttttttttttttttttttttttttttttt

SEQ ID NO: 8527 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnctagagcanntttttttttttttttttttttttttttttt

SEQ ID NO: 8528 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncttctagcnntttttttttttttttttttttttttttttt

SEQ ID NO: 8529 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngagtaacgnntttttttttttttttttttttttttttttt

SEQ ID NO: 8530 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnctaagaggnntttttttttttttttttttttttttttttt

SEQ ID NO: 8531 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnacgtgtagnntttttttttttttttttttttttttttttt

SEQ ID NO: 8532 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnactacaggnntttttttttttttttttttttttttttttt

SEQ ID NO: 8533 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntacaggtcnntttttttttttttttttttttttttttttt

SEQ ID NO: 8534 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnctcacatgnntttttttttttttttttttttttttttttt

SEQ ID NO: 8535 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnactaggagnntttttttttttttttttttttttttttttt

SEQ ID NO: 8536 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnccatagganntttttttttttttttttttttttttttttt

SEQ ID NO: 8537 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnggagaatcnntttttttttttttttttttttttttttttt

SEQ ID NO: 8538 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngccaagaanntttttttttttttttttttttttttttttt

SEQ ID NO: 8539 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnaaggcaagnntttttttttttttttttttttttttttttt

SEQ ID NO: 8540 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnaatgtcgcnntttttttttttttttttttttttttttttt

SEQ ID NO: 8541 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnatggaaccnntttttttttttttttttttttttttttttt

SEQ ID NO: 8542 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnagaggcatnntttttttttttttttttttttttttttttt

SEQ ID NO: 8543 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntgcatagcnntttttttttttttttttttttttttttttt

SEQ ID NO: 8544 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnctaacgganntttttttttttttttttttttttttttttt

SEQ ID NO: 8545 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntatcgaggnntttttttttttttttttttttttttttttt

SEQ ID NO: 8546 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncatagcctnntttttttttttttttttttttttttttttt

SEQ ID NO: 8547 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnatcgagacnntttttttttttttttttttttttttttttt

SEQ ID NO: 8548 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnggaagagtnntttttttttttttttttttttttttttttt

SEQ ID NO: 8549 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnccaagtagnntttttttttttttttttttttttttttttt

SEQ ID NO: 8550 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnctgaacagnntttttttttttttttttttttttttttttt

SEQ ID NO: 8551 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngtaggttcnntttttttttttttttttttttttttttttt

SEQ ID NO: 8552 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngtatggacnntttttttttttttttttttttttttttttt

SEQ ID NO: 8553 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntcgcaacanntttttttttttttttttttttttttttttt

SEQ ID NO: 8554 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnccgctaatnntttttttttttttttttttttttttttttt

SEQ ID NO: 8555 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngattcgcanntttttttttttttttttttttttttttttt

SEQ ID NO: 8556 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncgatggaanntttttttttttttttttttttttttttttt

SEQ ID NO: 8557 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnagcaagganntttttttttttttttttttttttttttttt

SEQ ID NO: 8558 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncgtagcaanntttttttttttttttttttttttttttttt

SEQ ID NO: 8559 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntggcagtanntttttttttttttttttttttttttttttt

SEQ ID NO: 8560 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncggtagttnntttttttttttttttttttttttttttttt

SEQ ID NO: 8561 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntgacttcgnntttttttttttttttttttttttttttttt

SEQ ID NO: 8562 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngagtgcaanntttttttttttttttttttttttttttttt

SEQ ID NO: 8563 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnacggtaacnntttttttttttttttttttttttttttttt

SEQ ID NO: 8564 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnaagtggtgnntttttttttttttttttttttttttttttt

SEQ ID NO: 8565 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnggagacaanntttttttttttttttttttttttttttttt

SEQ ID NO: 8566 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntcaaggacnntttttttttttttttttttttttttttttt

SEQ ID NO: 8567 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnaagagagcnntttttttttttttttttttttttttttttt

SEQ ID NO: 8568 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncgagagatnntttttttttttttttttttttttttttttt

SEQ ID NO: 8569 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnacagatggnntttttttttttttttttttttttttttttt

SEQ ID NO: 8570 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnaggagtcanntttttttttttttttttttttttttttttt

SEQ ID NO: 8571 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncgtgttacnntttttttttttttttttttttttttttttt

SEQ ID NO: 8572 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntagtgtgcnntttttttttttttttttttttttttttttt

SEQ ID NO: 8573 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnctcatgacnntttttttttttttttttttttttttttttt

SEQ ID NO: 8574 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngtatccagnntttttttttttttttttttttttttttttt

SEQ ID NO: 8575 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnacgcctatnntttttttttttttttttttttttttttttt

SEQ ID NO: 8576 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnaacgacctnntttttttttttttttttttttttttttttt

SEQ ID NO: 8577 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnatcaggctnntttttttttttttttttttttttttttttt

SEQ ID NO: 8578 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncaagttcgnntttttttttttttttttttttttttttttt

SEQ ID NO: 8579 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntagccaganntttttttttttttttttttttttttttttt

SEQ ID NO: 8580 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncaatcacgnntttttttttttttttttttttttttttttt

SEQ ID NO: 8581 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnngcaacaagnntttttttttttttttttttttttttttttt

SEQ ID NO: 8582 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncacgacaanntttttttttttttttttttttttttttttt

SEQ ID NO: 8583 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntacggaganntttttttttttttttttttttttttttttt

SEQ ID NO: 8584 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncgacaaganntttttttttttttttttttttttttttttt

SEQ ID NO: 8585 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncgaagtganntttttttttttttttttttttttttttttt

SEQ ID NO: 8586 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnagctggtanntttttttttttttttttttttttttttttt

SEQ ID NO: 8587 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnaactaggcnntttttttttttttttttttttttttttttt

SEQ ID NO: 8588 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncagcaagtnntttttttttttttttttttttttttttttt

SEQ ID NO: 8589 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnacgaggtanntttttttttttttttttttttttttttttt

SEQ ID NO: 8590 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncatcttccnntttttttttttttttttttttttttttttt

SEQ ID NO: 8591 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncctgaatcnntttttttttttttttttttttttttttttt

SEQ ID NO: 8592 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnntgcagactnntttttttttttttttttttttttttttttt

SEQ ID NO: 8593 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnagatgtggnntttttttttttttttttttttttttttttt

SEQ ID NO: 8594 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnagttcgacnntttttttttttttttttttttttttttttt

SEQ ID NO: 8595 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnnacaacctcnntttttttttttttttttttttttttttttt

SEQ ID NO: 8596 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncatggtagnntttttttttttttttttttttttttttttt

SEQ ID NO: 8597 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncgtatctcnntttttttttttttttttttttttttttttt

SEQ ID NO: 8598 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncctagttcnntttttttttttttttttttttttttttttt

SEQ ID NO: 8599 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacgaatccnncaagagtcnntttttttttttttttttttttttttttttt

SEQ ID NO: 8600 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnaatcggcanntttttttttttttttttttttttttttttt

SEQ ID NO: 8601 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntacggcatnntttttttttttttttttttttttttttttt

SEQ ID NO: 8602 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnttggatcgnntttttttttttttttttttttttttttttt

SEQ ID NO: 8603 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntggaacganntttttttttttttttttttttttttttttt

SEQ ID NO: 8604 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnggcaatcanntttttttttttttttttttttttttttttt

SEQ ID NO: 8605 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngaatccganntttttttttttttttttttttttttttttt

SEQ ID NO: 8606 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnttacggtgnntttttttttttttttttttttttttttttt

SEQ ID NO: 8607 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncatatcggnntttttttttttttttttttttttttttttt

SEQ ID NO: 8608 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncttcggtanntttttttttttttttttttttttttttttt

SEQ ID NO: 8609 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntcctaacgnntttttttttttttttttttttttttttttt

SEQ ID NO: 8610 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngtaagccanntttttttttttttttttttttttttttttt

SEQ ID NO: 8611 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntaaggtggnntttttttttttttttttttttttttttttt

SEQ ID NO: 8612 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnggtaagctnntttttttttttttttttttttttttttttt

SEQ ID NO: 8613 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntgtgtcganntttttttttttttttttttttttttttttt

SEQ ID NO: 8614 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngagcatganntttttttttttttttttttttttttttttt

SEQ ID NO: 8615 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntcgaagtcnntttttttttttttttttttttttttttttt

SEQ ID NO: 8616 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnggtgaacanntttttttttttttttttttttttttttttt

SEQ ID NO: 8617 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnacatgcacnntttttttttttttttttttttttttttttt

SEQ ID NO: 8618 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnccaacagtnntttttttttttttttttttttttttttttt

SEQ ID NO: 8619 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnagaacagcnntttttttttttttttttttttttttttttt

SEQ ID NO: 8620 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngaacacgtnntttttttttttttttttttttttttttttt

SEQ ID NO: 8621 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnggtcttcanntttttttttttttttttttttttttttttt

SEQ ID NO: 8622 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnaggttcagnntttttttttttttttttttttttttttttt

SEQ ID NO: 8623 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnctagagcanntttttttttttttttttttttttttttttt

SEQ ID NO: 8624 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncttctagcnntttttttttttttttttttttttttttttt

SEQ ID NO: 8625 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngagtaacgnntttttttttttttttttttttttttttttt

SEQ ID NO: 8626 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnctaagaggnntttttttttttttttttttttttttttttt

SEQ ID NO: 8627 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnacgtgtagnntttttttttttttttttttttttttttttt

SEQ ID NO: 8628 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnactacaggnntttttttttttttttttttttttttttttt

SEQ ID NO: 8629 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntacaggtcnntttttttttttttttttttttttttttttt

SEQ ID NO: 8630 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnctcacatgnntttttttttttttttttttttttttttttt

SEQ ID NO: 8631 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnactaggagnntttttttttttttttttttttttttttttt

SEQ ID NO: 8632 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnccatagganntttttttttttttttttttttttttttttt

SEQ ID NO: 8633 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnggagaatcnntttttttttttttttttttttttttttttt

SEQ ID NO: 8634 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngccaagaanntttttttttttttttttttttttttttttt

SEQ ID NO: 8635 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnaaggcaagnntttttttttttttttttttttttttttttt

SEQ ID NO: 8636 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnaatgtcgcnntttttttttttttttttttttttttttttt

SEQ ID NO: 8637 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnatggaaccnntttttttttttttttttttttttttttttt

SEQ ID NO: 8638 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnagaggcatnntttttttttttttttttttttttttttttt

SEQ ID NO: 8639 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntgcatagcnntttttttttttttttttttttttttttttt

SEQ ID NO: 8640 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnctaacgganntttttttttttttttttttttttttttttt

SEQ ID NO: 8641 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntatcgaggnntttttttttttttttttttttttttttttt

SEQ ID NO: 8642 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncatagcctnntttttttttttttttttttttttttttttt

SEQ ID NO: 8643 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnatcgagacnntttttttttttttttttttttttttttttt

SEQ ID NO: 8644 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnggaagagtnntttttttttttttttttttttttttttttt

SEQ ID NO: 8645 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnccaagtagnntttttttttttttttttttttttttttttt

SEQ ID NO: 8646 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnctgaacagnntttttttttttttttttttttttttttttt

SEQ ID NO: 8647 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngtaggttcnntttttttttttttttttttttttttttttt

SEQ ID NO: 8648 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngtatggacnntttttttttttttttttttttttttttttt

SEQ ID NO: 8649 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntcgcaacanntttttttttttttttttttttttttttttt

SEQ ID NO: 8650 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnccgctaatnntttttttttttttttttttttttttttttt

SEQ ID NO: 8651 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngattcgcanntttttttttttttttttttttttttttttt

SEQ ID NO: 8652 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncgatggaanntttttttttttttttttttttttttttttt

SEQ ID NO: 8653 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnagcaagganntttttttttttttttttttttttttttttt

SEQ ID NO: 8654 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncgtagcaanntttttttttttttttttttttttttttttt

SEQ ID NO: 8655 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntggcagtanntttttttttttttttttttttttttttttt

SEQ ID NO: 8656 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncggtagttnntttttttttttttttttttttttttttttt

SEQ ID NO: 8657 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntgacttcgnntttttttttttttttttttttttttttttt

SEQ ID NO: 8658 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngagtgcaanntttttttttttttttttttttttttttttt

SEQ ID NO: 8659 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnacggtaacnntttttttttttttttttttttttttttttt

SEQ ID NO: 8660 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnaagtggtgnntttttttttttttttttttttttttttttt

SEQ ID NO: 8661 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnggagacaanntttttttttttttttttttttttttttttt

SEQ ID NO: 8662 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntcaaggacnntttttttttttttttttttttttttttttt

SEQ ID NO: 8663 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnaagagagcnntttttttttttttttttttttttttttttt

SEQ ID NO: 8664 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncgagagatnntttttttttttttttttttttttttttttt

SEQ ID NO: 8665 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnacagatggnntttttttttttttttttttttttttttttt

SEQ ID NO: 8666 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnaggagtcanntttttttttttttttttttttttttttttt

SEQ ID NO: 8667 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncgtgttacnntttttttttttttttttttttttttttttt

SEQ ID NO: 8668 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntagtgtgcnntttttttttttttttttttttttttttttt

SEQ ID NO: 8669 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnctcatgacnntttttttttttttttttttttttttttttt

SEQ ID NO: 8670 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngtatccagnntttttttttttttttttttttttttttttt

SEQ ID NO: 8671 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnacgcctatnntttttttttttttttttttttttttttttt

SEQ ID NO: 8672 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnaacgacctnntttttttttttttttttttttttttttttt

SEQ ID NO: 8673 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnatcaggctnntttttttttttttttttttttttttttttt

SEQ ID NO: 8674 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncaagttcgnntttttttttttttttttttttttttttttt

SEQ ID NO: 8675 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntagccaganntttttttttttttttttttttttttttttt

SEQ ID NO: 8676 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncaatcacgnntttttttttttttttttttttttttttttt

SEQ ID NO: 8677 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnngcaacaagnntttttttttttttttttttttttttttttt

SEQ ID NO: 8678 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncacgacaanntttttttttttttttttttttttttttttt

SEQ ID NO: 8679 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntacggaganntttttttttttttttttttttttttttttt

SEQ ID NO: 8680 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncgacaaganntttttttttttttttttttttttttttttt

SEQ ID NO: 8681 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncgaagtganntttttttttttttttttttttttttttttt

SEQ ID NO: 8682 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnagctggtanntttttttttttttttttttttttttttttt

SEQ ID NO: 8683 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnaactaggcnntttttttttttttttttttttttttttttt

SEQ ID NO: 8684 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncagcaagtnntttttttttttttttttttttttttttttt

SEQ ID NO: 8685 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnacgaggtanntttttttttttttttttttttttttttttt

SEQ ID NO: 8686 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncatcttccnntttttttttttttttttttttttttttttt

SEQ ID NO: 8687 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncctgaatcnntttttttttttttttttttttttttttttt

SEQ ID NO: 8688 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnntgcagactnntttttttttttttttttttttttttttttt

SEQ ID NO: 8689 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnagatgtggnntttttttttttttttttttttttttttttt

SEQ ID NO: 8690 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnagttcgacnntttttttttttttttttttttttttttttt

SEQ ID NO: 8691 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnnacaacctcnntttttttttttttttttttttttttttttt

SEQ ID NO: 8692 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncatggtagnntttttttttttttttttttttttttttttt

SEQ ID NO: 8693 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncgtatctcnntttttttttttttttttttttttttttttt

SEQ ID NO: 8694 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncctagttcnntttttttttttttttttttttttttttttt

SEQ ID NO: 8695 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntaagaccgnncaagagtcnntttttttttttttttttttttttttttttt

SEQ ID NO: 8696 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnaatcggcanntttttttttttttttttttttttttttttt

SEQ ID NO: 8697 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntacggcatnntttttttttttttttttttttttttttttt

SEQ ID NO: 8698 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnttggatcgnntttttttttttttttttttttttttttttt

SEQ ID NO: 8699 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntggaacganntttttttttttttttttttttttttttttt

SEQ ID NO: 8700 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnggcaatcanntttttttttttttttttttttttttttttt

SEQ ID NO: 8701 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngaatccganntttttttttttttttttttttttttttttt

SEQ ID NO: 8702 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnttacggtgnntttttttttttttttttttttttttttttt

SEQ ID NO: 8703 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncatatcggnntttttttttttttttttttttttttttttt

SEQ ID NO: 8704 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncttcggtanntttttttttttttttttttttttttttttt

SEQ ID NO: 8705 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntcctaacgnntttttttttttttttttttttttttttttt

SEQ ID NO: 8706 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngtaagccanntttttttttttttttttttttttttttttt

SEQ ID NO: 8707 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntaaggtggnntttttttttttttttttttttttttttttt

SEQ ID NO: 8708 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnggtaagctnntttttttttttttttttttttttttttttt

SEQ ID NO: 8709 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntgtgtcganntttttttttttttttttttttttttttttt

SEQ ID NO: 8710 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngagcatganntttttttttttttttttttttttttttttt

SEQ ID NO: 8711 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntcgaagtcnntttttttttttttttttttttttttttttt

SEQ ID NO: 8712 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnggtgaacanntttttttttttttttttttttttttttttt

SEQ ID NO: 8713 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnacatgcacnntttttttttttttttttttttttttttttt

SEQ ID NO: 8714 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnccaacagtnntttttttttttttttttttttttttttttt

SEQ ID NO: 8715 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnagaacagcnntttttttttttttttttttttttttttttt

SEQ ID NO: 8716 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngaacacgtnntttttttttttttttttttttttttttttt

SEQ ID NO: 8717 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnggtcttcanntttttttttttttttttttttttttttttt

SEQ ID NO: 8718 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnaggttcagnntttttttttttttttttttttttttttttt

SEQ ID NO: 8719 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnctagagcanntttttttttttttttttttttttttttttt

SEQ ID NO: 8720 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncttctagcnntttttttttttttttttttttttttttttt

SEQ ID NO: 8721 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngagtaacgnntttttttttttttttttttttttttttttt

SEQ ID NO: 8722 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnctaagaggnntttttttttttttttttttttttttttttt

SEQ ID NO: 8723 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnacgtgtagnntttttttttttttttttttttttttttttt

SEQ ID NO: 8724 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnactacaggnntttttttttttttttttttttttttttttt

SEQ ID NO: 8725 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntacaggtcnntttttttttttttttttttttttttttttt

SEQ ID NO: 8726 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnctcacatgnntttttttttttttttttttttttttttttt

SEQ ID NO: 8727 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnactaggagnntttttttttttttttttttttttttttttt

SEQ ID NO: 8728 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnccatagganntttttttttttttttttttttttttttttt

SEQ ID NO: 8729 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnggagaatcnntttttttttttttttttttttttttttttt

SEQ ID NO: 8730 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngccaagaanntttttttttttttttttttttttttttttt

SEQ ID NO: 8731 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnaaggcaagnntttttttttttttttttttttttttttttt

SEQ ID NO: 8732 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnaatgtcgcnntttttttttttttttttttttttttttttt

SEQ ID NO: 8733 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnatggaaccnntttttttttttttttttttttttttttttt

SEQ ID NO: 8734 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnagaggcatnntttttttttttttttttttttttttttttt

SEQ ID NO: 8735 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntgcatagcnntttttttttttttttttttttttttttttt

SEQ ID NO: 8736 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnctaacgganntttttttttttttttttttttttttttttt

SEQ ID NO: 8737 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntatcgaggnntttttttttttttttttttttttttttttt

SEQ ID NO: 8738 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncatagcctnntttttttttttttttttttttttttttttt

SEQ ID NO: 8739 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnatcgagacnntttttttttttttttttttttttttttttt

SEQ ID NO: 8740 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnggaagagtnntttttttttttttttttttttttttttttt

SEQ ID NO: 8741 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnccaagtagnntttttttttttttttttttttttttttttt

SEQ ID NO: 8742 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnctgaacagnntttttttttttttttttttttttttttttt

SEQ ID NO: 8743 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngtaggttcnntttttttttttttttttttttttttttttt

SEQ ID NO: 8744 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngtatggacnntttttttttttttttttttttttttttttt

SEQ ID NO: 8745 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntcgcaacanntttttttttttttttttttttttttttttt

SEQ ID NO: 8746 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnccgctaatnntttttttttttttttttttttttttttttt

SEQ ID NO: 8747 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngattcgcanntttttttttttttttttttttttttttttt

SEQ ID NO: 8748 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncgatggaanntttttttttttttttttttttttttttttt

SEQ ID NO: 8749 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnagcaagganntttttttttttttttttttttttttttttt

SEQ ID NO: 8750 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncgtagcaanntttttttttttttttttttttttttttttt

SEQ ID NO: 8751 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntggcagtanntttttttttttttttttttttttttttttt

SEQ ID NO: 8752 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncggtagttnntttttttttttttttttttttttttttttt

SEQ ID NO: 8753 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntgacttcgnntttttttttttttttttttttttttttttt

SEQ ID NO: 8754 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngagtgcaanntttttttttttttttttttttttttttttt

SEQ ID NO: 8755 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnacggtaacnntttttttttttttttttttttttttttttt

SEQ ID NO: 8756 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnaagtggtgnntttttttttttttttttttttttttttttt

SEQ ID NO: 8757 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnggagacaanntttttttttttttttttttttttttttttt

SEQ ID NO: 8758 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntcaaggacnntttttttttttttttttttttttttttttt

SEQ ID NO: 8759 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnaagagagcnntttttttttttttttttttttttttttttt

SEQ ID NO: 8760 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncgagagatnntttttttttttttttttttttttttttttt

SEQ ID NO: 8761 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnacagatggnntttttttttttttttttttttttttttttt

SEQ ID NO: 8762 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnaggagtcanntttttttttttttttttttttttttttttt

SEQ ID NO: 8763 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncgtgttacnntttttttttttttttttttttttttttttt

SEQ ID NO: 8764 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntagtgtgcnntttttttttttttttttttttttttttttt

SEQ ID NO: 8765 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnctcatgacnntttttttttttttttttttttttttttttt

SEQ ID NO: 8766 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngtatccagnntttttttttttttttttttttttttttttt

SEQ ID NO: 8767 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnacgcctatnntttttttttttttttttttttttttttttt

SEQ ID NO: 8768 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnaacgacctnntttttttttttttttttttttttttttttt

SEQ ID NO: 8769 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnatcaggctnntttttttttttttttttttttttttttttt

SEQ ID NO: 8770 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncaagttcgnntttttttttttttttttttttttttttttt

SEQ ID NO: 8771 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntagccaganntttttttttttttttttttttttttttttt

SEQ ID NO: 8772 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncaatcacgnntttttttttttttttttttttttttttttt

SEQ ID NO: 8773 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnngcaacaagnntttttttttttttttttttttttttttttt

SEQ ID NO: 8774 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncacgacaanntttttttttttttttttttttttttttttt

SEQ ID NO: 8775 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntacggaganntttttttttttttttttttttttttttttt

SEQ ID NO: 8776 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncgacaaganntttttttttttttttttttttttttttttt

SEQ ID NO: 8777 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncgaagtganntttttttttttttttttttttttttttttt

SEQ ID NO: 8778 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnagctggtanntttttttttttttttttttttttttttttt

SEQ ID NO: 8779 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnaactaggcnntttttttttttttttttttttttttttttt

SEQ ID NO: 8780 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncagcaagtnntttttttttttttttttttttttttttttt

SEQ ID NO: 8781 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnacgaggtanntttttttttttttttttttttttttttttt

SEQ ID NO: 8782 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncatcttccnntttttttttttttttttttttttttttttt

SEQ ID NO: 8783 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncctgaatcnntttttttttttttttttttttttttttttt

SEQ ID NO: 8784 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnntgcagactnntttttttttttttttttttttttttttttt

SEQ ID NO: 8785 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnagatgtggnntttttttttttttttttttttttttttttt

SEQ ID NO: 8786 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnagttcgacnntttttttttttttttttttttttttttttt

SEQ ID NO: 8787 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnnacaacctcnntttttttttttttttttttttttttttttt

SEQ ID NO: 8788 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncatggtagnntttttttttttttttttttttttttttttt

SEQ ID NO: 8789 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncgtatctcnntttttttttttttttttttttttttttttt

SEQ ID NO: 8790 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncctagttcnntttttttttttttttttttttttttttttt

SEQ ID NO: 8791 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntctatggcnncaagagtcnntttttttttttttttttttttttttttttt

SEQ ID NO: 8792 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnaatcggcanntttttttttttttttttttttttttttttt

SEQ ID NO: 8793 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntacggcatnntttttttttttttttttttttttttttttt

SEQ ID NO: 8794 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnttggatcgnntttttttttttttttttttttttttttttt

SEQ ID NO: 8795 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntggaacganntttttttttttttttttttttttttttttt

SEQ ID NO: 8796 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnggcaatcanntttttttttttttttttttttttttttttt

SEQ ID NO: 8797 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngaatccganntttttttttttttttttttttttttttttt

SEQ ID NO: 8798 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnttacggtgnntttttttttttttttttttttttttttttt

SEQ ID NO: 8799 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncatatcggnntttttttttttttttttttttttttttttt

SEQ ID NO: 8800 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncttcggtanntttttttttttttttttttttttttttttt

SEQ ID NO: 8801 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntcctaacgnntttttttttttttttttttttttttttttt

SEQ ID NO: 8802 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngtaagccanntttttttttttttttttttttttttttttt

SEQ ID NO: 8803 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntaaggtggnntttttttttttttttttttttttttttttt

SEQ ID NO: 8804 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnggtaagctnntttttttttttttttttttttttttttttt

SEQ ID NO: 8805 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntgtgtcganntttttttttttttttttttttttttttttt

SEQ ID NO: 8806 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngagcatganntttttttttttttttttttttttttttttt

SEQ ID NO: 8807 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntcgaagtcnntttttttttttttttttttttttttttttt

SEQ ID NO: 8808 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnggtgaacanntttttttttttttttttttttttttttttt

SEQ ID NO: 8809 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnacatgcacnntttttttttttttttttttttttttttttt

SEQ ID NO: 8810 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnccaacagtnntttttttttttttttttttttttttttttt

SEQ ID NO: 8811 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnagaacagcnntttttttttttttttttttttttttttttt

SEQ ID NO: 8812 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngaacacgtnntttttttttttttttttttttttttttttt

SEQ ID NO: 8813 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnggtcttcanntttttttttttttttttttttttttttttt

SEQ ID NO: 8814 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnaggttcagnntttttttttttttttttttttttttttttt

SEQ ID NO: 8815 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnctagagcanntttttttttttttttttttttttttttttt

SEQ ID NO: 8816 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncttctagcnntttttttttttttttttttttttttttttt

SEQ ID NO: 8817 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngagtaacgnntttttttttttttttttttttttttttttt

SEQ ID NO: 8818 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnctaagaggnntttttttttttttttttttttttttttttt

SEQ ID NO: 8819 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnacgtgtagnntttttttttttttttttttttttttttttt

SEQ ID NO: 8820 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnactacaggnntttttttttttttttttttttttttttttt

SEQ ID NO: 8821 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntacaggtcnntttttttttttttttttttttttttttttt

SEQ ID NO: 8822 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnctcacatgnntttttttttttttttttttttttttttttt

SEQ ID NO: 8823 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnactaggagnntttttttttttttttttttttttttttttt

SEQ ID NO: 8824 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnccatagganntttttttttttttttttttttttttttttt

SEQ ID NO: 8825 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnggagaatcnntttttttttttttttttttttttttttttt

SEQ ID NO: 8826 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngccaagaanntttttttttttttttttttttttttttttt

SEQ ID NO: 8827 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnaaggcaagnntttttttttttttttttttttttttttttt

SEQ ID NO: 8828 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnaatgtcgcnntttttttttttttttttttttttttttttt

SEQ ID NO: 8829 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnatggaaccnntttttttttttttttttttttttttttttt

SEQ ID NO: 8830 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnagaggcatnntttttttttttttttttttttttttttttt

SEQ ID NO: 8831 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntgcatagcnntttttttttttttttttttttttttttttt

SEQ ID NO: 8832 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnctaacgganntttttttttttttttttttttttttttttt

SEQ ID NO: 8833 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntatcgaggnntttttttttttttttttttttttttttttt

SEQ ID NO: 8834 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncatagcctnntttttttttttttttttttttttttttttt

SEQ ID NO: 8835 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnatcgagacnntttttttttttttttttttttttttttttt

SEQ ID NO: 8836 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnggaagagtnntttttttttttttttttttttttttttttt

SEQ ID NO: 8837 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnccaagtagnntttttttttttttttttttttttttttttt

SEQ ID NO: 8838 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnctgaacagnntttttttttttttttttttttttttttttt

SEQ ID NO: 8839 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngtaggttcnntttttttttttttttttttttttttttttt

SEQ ID NO: 8840 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngtatggacnntttttttttttttttttttttttttttttt

SEQ ID NO: 8841 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntcgcaacanntttttttttttttttttttttttttttttt

SEQ ID NO: 8842 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnccgctaatnntttttttttttttttttttttttttttttt

SEQ ID NO: 8843 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngattcgcanntttttttttttttttttttttttttttttt

SEQ ID NO: 8844 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncgatggaanntttttttttttttttttttttttttttttt

SEQ ID NO: 8845 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnagcaagganntttttttttttttttttttttttttttttt

SEQ ID NO: 8846 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncgtagcaanntttttttttttttttttttttttttttttt

SEQ ID NO: 8847 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntggcagtanntttttttttttttttttttttttttttttt

SEQ ID NO: 8848 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncggtagttnntttttttttttttttttttttttttttttt

SEQ ID NO: 8849 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntgacttcgnntttttttttttttttttttttttttttttt

SEQ ID NO: 8850 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngagtgcaanntttttttttttttttttttttttttttttt

SEQ ID NO: 8851 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnacggtaacnntttttttttttttttttttttttttttttt

SEQ ID NO: 8852 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnaagtggtgnntttttttttttttttttttttttttttttt

SEQ ID NO: 8853 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnggagacaanntttttttttttttttttttttttttttttt

SEQ ID NO: 8854 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntcaaggacnntttttttttttttttttttttttttttttt

SEQ ID NO: 8855 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnaagagagcnntttttttttttttttttttttttttttttt

SEQ ID NO: 8856 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncgagagatnntttttttttttttttttttttttttttttt

SEQ ID NO: 8857 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnacagatggnntttttttttttttttttttttttttttttt

SEQ ID NO: 8858 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnaggagtcanntttttttttttttttttttttttttttttt

SEQ ID NO: 8859 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncgtgttacnntttttttttttttttttttttttttttttt

SEQ ID NO: 8860 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntagtgtgcnntttttttttttttttttttttttttttttt

SEQ ID NO: 8861 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnctcatgacnntttttttttttttttttttttttttttttt

SEQ ID NO: 8862 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngtatccagnntttttttttttttttttttttttttttttt

SEQ ID NO: 8863 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnacgcctatnntttttttttttttttttttttttttttttt

SEQ ID NO: 8864 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnaacgacctnntttttttttttttttttttttttttttttt

SEQ ID NO: 8865 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnatcaggctnntttttttttttttttttttttttttttttt

SEQ ID NO: 8866 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncaagttcgnntttttttttttttttttttttttttttttt

SEQ ID NO: 8867 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntagccaganntttttttttttttttttttttttttttttt

SEQ ID NO: 8868 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncaatcacgnntttttttttttttttttttttttttttttt

SEQ ID NO: 8869 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnngcaacaagnntttttttttttttttttttttttttttttt

SEQ ID NO: 8870 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncacgacaanntttttttttttttttttttttttttttttt

SEQ ID NO: 8871 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntacggaganntttttttttttttttttttttttttttttt

SEQ ID NO: 8872 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncgacaaganntttttttttttttttttttttttttttttt

SEQ ID NO: 8873 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncgaagtganntttttttttttttttttttttttttttttt

SEQ ID NO: 8874 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnagctggtanntttttttttttttttttttttttttttttt

SEQ ID NO: 8875 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnaactaggcnntttttttttttttttttttttttttttttt

SEQ ID NO: 8876 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncagcaagtnntttttttttttttttttttttttttttttt

SEQ ID NO: 8877 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnacgaggtanntttttttttttttttttttttttttttttt

SEQ ID NO: 8878 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncatcttccnntttttttttttttttttttttttttttttt

SEQ ID NO: 8879 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncctgaatcnntttttttttttttttttttttttttttttt

SEQ ID NO: 8880 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnntgcagactnntttttttttttttttttttttttttttttt

SEQ ID NO: 8881 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnagatgtggnntttttttttttttttttttttttttttttt

SEQ ID NO: 8882 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnagttcgacnntttttttttttttttttttttttttttttt

SEQ ID NO: 8883 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnnacaacctcnntttttttttttttttttttttttttttttt

SEQ ID NO: 8884 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncatggtagnntttttttttttttttttttttttttttttt

SEQ ID NO: 8885 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncgtatctcnntttttttttttttttttttttttttttttt

SEQ ID NO: 8886 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncctagttcnntttttttttttttttttttttttttttttt

SEQ ID NO: 8887 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnncaaggatgnncaagagtcnntttttttttttttttttttttttttttttt

SEQ ID NO: 8888 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnaatcggcanntttttttttttttttttttttttttttttt

SEQ ID NO: 8889 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntacggcatnntttttttttttttttttttttttttttttt

SEQ ID NO: 8890 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnttggatcgnntttttttttttttttttttttttttttttt

SEQ ID NO: 8891 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntggaacganntttttttttttttttttttttttttttttt

SEQ ID NO: 8892 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnggcaatcanntttttttttttttttttttttttttttttt

SEQ ID NO: 8893 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngaatccganntttttttttttttttttttttttttttttt

SEQ ID NO: 8894 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnttacggtgnntttttttttttttttttttttttttttttt

SEQ ID NO: 8895 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncatatcggnntttttttttttttttttttttttttttttt

SEQ ID NO: 8896 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncttcggtanntttttttttttttttttttttttttttttt

SEQ ID NO: 8897 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntcctaacgnntttttttttttttttttttttttttttttt

SEQ ID NO: 8898 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngtaagccanntttttttttttttttttttttttttttttt

SEQ ID NO: 8899 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntaaggtggnntttttttttttttttttttttttttttttt

SEQ ID NO: 8900 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnggtaagctnntttttttttttttttttttttttttttttt

SEQ ID NO: 8901 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntgtgtcganntttttttttttttttttttttttttttttt

SEQ ID NO: 8902 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngagcatganntttttttttttttttttttttttttttttt

SEQ ID NO: 8903 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntcgaagtcnntttttttttttttttttttttttttttttt

SEQ ID NO: 8904 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnggtgaacanntttttttttttttttttttttttttttttt

SEQ ID NO: 8905 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnacatgcacnntttttttttttttttttttttttttttttt

SEQ ID NO: 8906 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnccaacagtnntttttttttttttttttttttttttttttt

SEQ ID NO: 8907 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnagaacagcnntttttttttttttttttttttttttttttt

SEQ ID NO: 8908 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngaacacgtnntttttttttttttttttttttttttttttt

SEQ ID NO: 8909 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnggtcttcanntttttttttttttttttttttttttttttt

SEQ ID NO: 8910 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnaggttcagnntttttttttttttttttttttttttttttt

SEQ ID NO: 8911 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnctagagcanntttttttttttttttttttttttttttttt

SEQ ID NO: 8912 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncttctagcnntttttttttttttttttttttttttttttt

SEQ ID NO: 8913 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngagtaacgnntttttttttttttttttttttttttttttt

SEQ ID NO: 8914 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnctaagaggnntttttttttttttttttttttttttttttt

SEQ ID NO: 8915 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnacgtgtagnntttttttttttttttttttttttttttttt

SEQ ID NO: 8916 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnactacaggnntttttttttttttttttttttttttttttt

SEQ ID NO: 8917 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntacaggtcnntttttttttttttttttttttttttttttt

SEQ ID NO: 8918 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnctcacatgnntttttttttttttttttttttttttttttt

SEQ ID NO: 8919 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnactaggagnntttttttttttttttttttttttttttttt

SEQ ID NO: 8920 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnccatagganntttttttttttttttttttttttttttttt

SEQ ID NO: 8921 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnggagaatcnntttttttttttttttttttttttttttttt

SEQ ID NO: 8922 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngccaagaanntttttttttttttttttttttttttttttt

SEQ ID NO: 8923 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnaaggcaagnntttttttttttttttttttttttttttttt

SEQ ID NO: 8924 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnaatgtcgcnntttttttttttttttttttttttttttttt

SEQ ID NO: 8925 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnatggaaccnntttttttttttttttttttttttttttttt

SEQ ID NO: 8926 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnagaggcatnntttttttttttttttttttttttttttttt

SEQ ID NO: 8927 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntgcatagcnntttttttttttttttttttttttttttttt

SEQ ID NO: 8928 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnctaacgganntttttttttttttttttttttttttttttt

SEQ ID NO: 8929 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntatcgaggnntttttttttttttttttttttttttttttt

SEQ ID NO: 8930 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncatagcctnntttttttttttttttttttttttttttttt

SEQ ID NO: 8931 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnatcgagacnntttttttttttttttttttttttttttttt

SEQ ID NO: 8932 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnggaagagtnntttttttttttttttttttttttttttttt

SEQ ID NO: 8933 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnccaagtagnntttttttttttttttttttttttttttttt

SEQ ID NO: 8934 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnctgaacagnntttttttttttttttttttttttttttttt

SEQ ID NO: 8935 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngtaggttcnntttttttttttttttttttttttttttttt

SEQ ID NO: 8936 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngtatggacnntttttttttttttttttttttttttttttt

SEQ ID NO: 8937 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntcgcaacanntttttttttttttttttttttttttttttt

SEQ ID NO: 8938 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnccgctaatnntttttttttttttttttttttttttttttt

SEQ ID NO: 8939 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngattcgcanntttttttttttttttttttttttttttttt

SEQ ID NO: 8940 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncgatggaanntttttttttttttttttttttttttttttt

SEQ ID NO: 8941 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnagcaagganntttttttttttttttttttttttttttttt

SEQ ID NO: 8942 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncgtagcaanntttttttttttttttttttttttttttttt

SEQ ID NO: 8943 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntggcagtanntttttttttttttttttttttttttttttt

SEQ ID NO: 8944 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncggtagttnntttttttttttttttttttttttttttttt

SEQ ID NO: 8945 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntgacttcgnntttttttttttttttttttttttttttttt

SEQ ID NO: 8946 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngagtgcaanntttttttttttttttttttttttttttttt

SEQ ID NO: 8947 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnacggtaacnntttttttttttttttttttttttttttttt

SEQ ID NO: 8948 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnaagtggtgnntttttttttttttttttttttttttttttt

SEQ ID NO: 8949 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnggagacaanntttttttttttttttttttttttttttttt

SEQ ID NO: 8950 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntcaaggacnntttttttttttttttttttttttttttttt

SEQ ID NO: 8951 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnaagagagcnntttttttttttttttttttttttttttttt

SEQ ID NO: 8952 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncgagagatnntttttttttttttttttttttttttttttt

SEQ ID NO: 8953 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnacagatggnntttttttttttttttttttttttttttttt

SEQ ID NO: 8954 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnaggagtcanntttttttttttttttttttttttttttttt

SEQ ID NO: 8955 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncgtgttacnntttttttttttttttttttttttttttttt

SEQ ID NO: 8956 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntagtgtgcnntttttttttttttttttttttttttttttt

SEQ ID NO: 8957 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnctcatgacnntttttttttttttttttttttttttttttt

SEQ ID NO: 8958 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngtatccagnntttttttttttttttttttttttttttttt

SEQ ID NO: 8959 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnacgcctatnntttttttttttttttttttttttttttttt

SEQ ID NO: 8960 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnaacgacctnntttttttttttttttttttttttttttttt

SEQ ID NO: 8961 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnatcaggctnntttttttttttttttttttttttttttttt

SEQ ID NO: 8962 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncaagttcgnntttttttttttttttttttttttttttttt

SEQ ID NO: 8963 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntagccaganntttttttttttttttttttttttttttttt

SEQ ID NO: 8964 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncaatcacgnntttttttttttttttttttttttttttttt

SEQ ID NO: 8965 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnngcaacaagnntttttttttttttttttttttttttttttt

SEQ ID NO: 8966 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncacgacaanntttttttttttttttttttttttttttttt

SEQ ID NO: 8967 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntacggaganntttttttttttttttttttttttttttttt

SEQ ID NO: 8968 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncgacaaganntttttttttttttttttttttttttttttt

SEQ ID NO: 8969 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncgaagtganntttttttttttttttttttttttttttttt

SEQ ID NO: 8970 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnagctggtanntttttttttttttttttttttttttttttt

SEQ ID NO: 8971 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnaactaggcnntttttttttttttttttttttttttttttt

SEQ ID NO: 8972 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncagcaagtnntttttttttttttttttttttttttttttt

SEQ ID NO: 8973 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnacgaggtanntttttttttttttttttttttttttttttt

SEQ ID NO: 8974 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncatcttccnntttttttttttttttttttttttttttttt

SEQ ID NO: 8975 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncctgaatcnntttttttttttttttttttttttttttttt

SEQ ID NO: 8976 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnntgcagactnntttttttttttttttttttttttttttttt

SEQ ID NO: 8977 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnagatgtggnntttttttttttttttttttttttttttttt

SEQ ID NO: 8978 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnagttcgacnntttttttttttttttttttttttttttttt

SEQ ID NO: 8979 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnnacaacctcnntttttttttttttttttttttttttttttt

SEQ ID NO: 8980 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncatggtagnntttttttttttttttttttttttttttttt

SEQ ID NO: 8981 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncgtatctcnntttttttttttttttttttttttttttttt

SEQ ID NO: 8982 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncctagttcnntttttttttttttttttttttttttttttt

SEQ ID NO: 8983 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcagaaccnncaagagtcnntttttttttttttttttttttttttttttt

SEQ ID NO: 8984 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnaatcggcanntttttttttttttttttttttttttttttt

SEQ ID NO: 8985 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntacggcatnntttttttttttttttttttttttttttttt

SEQ ID NO: 8986 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnttggatcgnntttttttttttttttttttttttttttttt

SEQ ID NO: 8987 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntggaacganntttttttttttttttttttttttttttttt

SEQ ID NO: 8988 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnggcaatcanntttttttttttttttttttttttttttttt

SEQ ID NO: 8989 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngaatccganntttttttttttttttttttttttttttttt

SEQ ID NO: 8990 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnttacggtgnntttttttttttttttttttttttttttttt

SEQ ID NO: 8991 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncatatcggnntttttttttttttttttttttttttttttt

SEQ ID NO: 8992 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncttcggtanntttttttttttttttttttttttttttttt

SEQ ID NO: 8993 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntcctaacgnntttttttttttttttttttttttttttttt

SEQ ID NO: 8994 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngtaagccanntttttttttttttttttttttttttttttt

SEQ ID NO: 8995 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntaaggtggnntttttttttttttttttttttttttttttt

SEQ ID NO: 8996 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnggtaagctnntttttttttttttttttttttttttttttt

SEQ ID NO: 8997 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntgtgtcganntttttttttttttttttttttttttttttt

SEQ ID NO: 8998 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngagcatganntttttttttttttttttttttttttttttt

SEQ ID NO: 8999 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntcgaagtcnntttttttttttttttttttttttttttttt

SEQ ID NO: 9000 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnggtgaacanntttttttttttttttttttttttttttttt

SEQ ID NO: 9001 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnacatgcacnntttttttttttttttttttttttttttttt

SEQ ID NO: 9002 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnccaacagtnntttttttttttttttttttttttttttttt

SEQ ID NO: 9003 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnagaacagcnntttttttttttttttttttttttttttttt

SEQ ID NO: 9004 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngaacacgtnntttttttttttttttttttttttttttttt

SEQ ID NO: 9005 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnggtcttcanntttttttttttttttttttttttttttttt

SEQ ID NO: 9006 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnaggttcagnntttttttttttttttttttttttttttttt

SEQ ID NO: 9007 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnctagagcanntttttttttttttttttttttttttttttt

SEQ ID NO: 9008 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncttctagcnntttttttttttttttttttttttttttttt

SEQ ID NO: 9009 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngagtaacgnntttttttttttttttttttttttttttttt

SEQ ID NO: 9010 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnctaagaggnntttttttttttttttttttttttttttttt

SEQ ID NO: 9011 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnacgtgtagnntttttttttttttttttttttttttttttt

SEQ ID NO: 9012 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnactacaggnntttttttttttttttttttttttttttttt

SEQ ID NO: 9013 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntacaggtcnntttttttttttttttttttttttttttttt

SEQ ID NO: 9014 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnctcacatgnntttttttttttttttttttttttttttttt

SEQ ID NO: 9015 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnactaggagnntttttttttttttttttttttttttttttt

SEQ ID NO: 9016 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnccatagganntttttttttttttttttttttttttttttt

SEQ ID NO: 9017 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnggagaatcnntttttttttttttttttttttttttttttt

SEQ ID NO: 9018 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngccaagaanntttttttttttttttttttttttttttttt

SEQ ID NO: 9019 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnaaggcaagnntttttttttttttttttttttttttttttt

SEQ ID NO: 9020 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnaatgtcgcnntttttttttttttttttttttttttttttt

SEQ ID NO: 9021 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnatggaaccnntttttttttttttttttttttttttttttt

SEQ ID NO: 9022 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnagaggcatnntttttttttttttttttttttttttttttt

SEQ ID NO: 9023 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntgcatagcnntttttttttttttttttttttttttttttt

SEQ ID NO: 9024 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnctaacgganntttttttttttttttttttttttttttttt

SEQ ID NO: 9025 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntatcgaggnntttttttttttttttttttttttttttttt

SEQ ID NO: 9026 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncatagcctnntttttttttttttttttttttttttttttt

SEQ ID NO: 9027 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnatcgagacnntttttttttttttttttttttttttttttt

SEQ ID NO: 9028 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnggaagagtnntttttttttttttttttttttttttttttt

SEQ ID NO: 9029 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnccaagtagnntttttttttttttttttttttttttttttt

SEQ ID NO: 9030 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnctgaacagnntttttttttttttttttttttttttttttt

SEQ ID NO: 9031 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngtaggttcnntttttttttttttttttttttttttttttt

SEQ ID NO: 9032 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngtatggacnntttttttttttttttttttttttttttttt

SEQ ID NO: 9033 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntcgcaacanntttttttttttttttttttttttttttttt

SEQ ID NO: 9034 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnccgctaatnntttttttttttttttttttttttttttttt

SEQ ID NO: 9035 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngattcgcanntttttttttttttttttttttttttttttt

SEQ ID NO: 9036 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncgatggaanntttttttttttttttttttttttttttttt

SEQ ID NO: 9037 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnagcaagganntttttttttttttttttttttttttttttt

SEQ ID NO: 9038 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncgtagcaanntttttttttttttttttttttttttttttt

SEQ ID NO: 9039 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntggcagtanntttttttttttttttttttttttttttttt

SEQ ID NO: 9040 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncggtagttnntttttttttttttttttttttttttttttt

SEQ ID NO: 9041 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntgacttcgnntttttttttttttttttttttttttttttt

SEQ ID NO: 9042 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngagtgcaanntttttttttttttttttttttttttttttt

SEQ ID NO: 9043 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnacggtaacnntttttttttttttttttttttttttttttt

SEQ ID NO: 9044 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnaagtggtgnntttttttttttttttttttttttttttttt

SEQ ID NO: 9045 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnggagacaanntttttttttttttttttttttttttttttt

SEQ ID NO: 9046 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntcaaggacnntttttttttttttttttttttttttttttt

SEQ ID NO: 9047 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnaagagagcnntttttttttttttttttttttttttttttt

SEQ ID NO: 9048 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncgagagatnntttttttttttttttttttttttttttttt

SEQ ID NO: 9049 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnacagatggnntttttttttttttttttttttttttttttt

SEQ ID NO: 9050 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnaggagtcanntttttttttttttttttttttttttttttt

SEQ ID NO: 9051 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncgtgttacnntttttttttttttttttttttttttttttt

SEQ ID NO: 9052 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntagtgtgcnntttttttttttttttttttttttttttttt

SEQ ID NO: 9053 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnctcatgacnntttttttttttttttttttttttttttttt

SEQ ID NO: 9054 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngtatccagnntttttttttttttttttttttttttttttt

SEQ ID NO: 9055 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnacgcctatnntttttttttttttttttttttttttttttt

SEQ ID NO: 9056 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnaacgacctnntttttttttttttttttttttttttttttt

SEQ ID NO: 9057 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnatcaggctnntttttttttttttttttttttttttttttt

SEQ ID NO: 9058 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncaagttcgnntttttttttttttttttttttttttttttt

SEQ ID NO: 9059 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntagccaganntttttttttttttttttttttttttttttt

SEQ ID NO: 9060 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncaatcacgnntttttttttttttttttttttttttttttt

SEQ ID NO: 9061 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnngcaacaagnntttttttttttttttttttttttttttttt

SEQ ID NO: 9062 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncacgacaanntttttttttttttttttttttttttttttt

SEQ ID NO: 9063 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntacggaganntttttttttttttttttttttttttttttt

SEQ ID NO: 9064 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncgacaaganntttttttttttttttttttttttttttttt

SEQ ID NO: 9065 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncgaagtganntttttttttttttttttttttttttttttt

SEQ ID NO: 9066 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnagctggtanntttttttttttttttttttttttttttttt

SEQ ID NO: 9067 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnaactaggcnntttttttttttttttttttttttttttttt

SEQ ID NO: 9068 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncagcaagtnntttttttttttttttttttttttttttttt

SEQ ID NO: 9069 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnacgaggtanntttttttttttttttttttttttttttttt

SEQ ID NO: 9070 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncatcttccnntttttttttttttttttttttttttttttt

SEQ ID NO: 9071 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncctgaatcnntttttttttttttttttttttttttttttt

SEQ ID NO: 9072 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnntgcagactnntttttttttttttttttttttttttttttt

SEQ ID NO: 9073 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnagatgtggnntttttttttttttttttttttttttttttt

SEQ ID NO: 9074 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnagttcgacnntttttttttttttttttttttttttttttt

SEQ ID NO: 9075 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnnacaacctcnntttttttttttttttttttttttttttttt

SEQ ID NO: 9076 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncatggtagnntttttttttttttttttttttttttttttt

SEQ ID NO: 9077 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncgtatctcnntttttttttttttttttttttttttttttt

SEQ ID NO: 9078 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncctagttcnntttttttttttttttttttttttttttttt

SEQ ID NO: 9079 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntcatgtccnncaagagtcnntttttttttttttttttttttttttttttt

SEQ ID NO: 9080 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnaatcggcanntttttttttttttttttttttttttttttt

SEQ ID NO: 9081 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntacggcatnntttttttttttttttttttttttttttttt

SEQ ID NO: 9082 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnttggatcgnntttttttttttttttttttttttttttttt

SEQ ID NO: 9083 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntggaacganntttttttttttttttttttttttttttttt

SEQ ID NO: 9084 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnggcaatcanntttttttttttttttttttttttttttttt

SEQ ID NO: 9085 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngaatccganntttttttttttttttttttttttttttttt

SEQ ID NO: 9086 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnttacggtgnntttttttttttttttttttttttttttttt

SEQ ID NO: 9087 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncatatcggnntttttttttttttttttttttttttttttt

SEQ ID NO: 9088 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncttcggtanntttttttttttttttttttttttttttttt

SEQ ID NO: 9089 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntcctaacgnntttttttttttttttttttttttttttttt

SEQ ID NO: 9090 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngtaagccanntttttttttttttttttttttttttttttt

SEQ ID NO: 9091 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntaaggtggnntttttttttttttttttttttttttttttt

SEQ ID NO: 9092 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnggtaagctnntttttttttttttttttttttttttttttt

SEQ ID NO: 9093 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntgtgtcganntttttttttttttttttttttttttttttt

SEQ ID NO: 9094 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngagcatganntttttttttttttttttttttttttttttt

SEQ ID NO: 9095 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntcgaagtcnntttttttttttttttttttttttttttttt

SEQ ID NO: 9096 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnggtgaacanntttttttttttttttttttttttttttttt

SEQ ID NO: 9097 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnacatgcacnntttttttttttttttttttttttttttttt

SEQ ID NO: 9098 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnccaacagtnntttttttttttttttttttttttttttttt

SEQ ID NO: 9099 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnagaacagcnntttttttttttttttttttttttttttttt

SEQ ID NO: 9100 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngaacacgtnntttttttttttttttttttttttttttttt

SEQ ID NO: 9101 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnggtcttcanntttttttttttttttttttttttttttttt

SEQ ID NO: 9102 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnaggttcagnntttttttttttttttttttttttttttttt

SEQ ID NO: 9103 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnctagagcanntttttttttttttttttttttttttttttt

SEQ ID NO: 9104 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncttctagcnntttttttttttttttttttttttttttttt

SEQ ID NO: 9105 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngagtaacgnntttttttttttttttttttttttttttttt

SEQ ID NO: 9106 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnctaagaggnntttttttttttttttttttttttttttttt

SEQ ID NO: 9107 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnacgtgtagnntttttttttttttttttttttttttttttt

SEQ ID NO: 9108 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnactacaggnntttttttttttttttttttttttttttttt

SEQ ID NO: 9109 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntacaggtcnntttttttttttttttttttttttttttttt

SEQ ID NO: 9110 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnctcacatgnntttttttttttttttttttttttttttttt

SEQ ID NO: 9111 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnactaggagnntttttttttttttttttttttttttttttt

SEQ ID NO: 9112 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnccatagganntttttttttttttttttttttttttttttt

SEQ ID NO: 9113 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnggagaatcnntttttttttttttttttttttttttttttt

SEQ ID NO: 9114 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngccaagaanntttttttttttttttttttttttttttttt

SEQ ID NO: 9115 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnaaggcaagnntttttttttttttttttttttttttttttt

SEQ ID NO: 9116 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnaatgtcgcnntttttttttttttttttttttttttttttt

SEQ ID NO: 9117 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnatggaaccnntttttttttttttttttttttttttttttt

SEQ ID NO: 9118 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnagaggcatnntttttttttttttttttttttttttttttt

SEQ ID NO: 9119 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntgcatagcnntttttttttttttttttttttttttttttt

SEQ ID NO: 9120 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnctaacgganntttttttttttttttttttttttttttttt

SEQ ID NO: 9121 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntatcgaggnntttttttttttttttttttttttttttttt

SEQ ID NO: 9122 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncatagcctnntttttttttttttttttttttttttttttt

SEQ ID NO: 9123 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnatcgagacnntttttttttttttttttttttttttttttt

SEQ ID NO: 9124 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnggaagagtnntttttttttttttttttttttttttttttt

SEQ ID NO: 9125 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnccaagtagnntttttttttttttttttttttttttttttt

SEQ ID NO: 9126 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnctgaacagnntttttttttttttttttttttttttttttt

SEQ ID NO: 9127 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngtaggttcnntttttttttttttttttttttttttttttt

SEQ ID NO: 9128 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngtatggacnntttttttttttttttttttttttttttttt

SEQ ID NO: 9129 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntcgcaacanntttttttttttttttttttttttttttttt

SEQ ID NO: 9130 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnccgctaatnntttttttttttttttttttttttttttttt

SEQ ID NO: 9131 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngattcgcanntttttttttttttttttttttttttttttt

SEQ ID NO: 9132 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncgatggaanntttttttttttttttttttttttttttttt

SEQ ID NO: 9133 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnagcaagganntttttttttttttttttttttttttttttt

SEQ ID NO: 9134 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncgtagcaanntttttttttttttttttttttttttttttt

SEQ ID NO: 9135 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntggcagtanntttttttttttttttttttttttttttttt

SEQ ID NO: 9136 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncggtagttnntttttttttttttttttttttttttttttt

SEQ ID NO: 9137 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntgacttcgnntttttttttttttttttttttttttttttt

SEQ ID NO: 9138 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngagtgcaanntttttttttttttttttttttttttttttt

SEQ ID NO: 9139 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnacggtaacnntttttttttttttttttttttttttttttt

SEQ ID NO: 9140 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnaagtggtgnntttttttttttttttttttttttttttttt

SEQ ID NO: 9141 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnggagacaanntttttttttttttttttttttttttttttt

SEQ ID NO: 9142 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntcaaggacnntttttttttttttttttttttttttttttt

SEQ ID NO: 9143 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnaagagagcnntttttttttttttttttttttttttttttt

SEQ ID NO: 9144 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncgagagatnntttttttttttttttttttttttttttttt

SEQ ID NO: 9145 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnacagatggnntttttttttttttttttttttttttttttt

SEQ ID NO: 9146 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnaggagtcanntttttttttttttttttttttttttttttt

SEQ ID NO: 9147 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncgtgttacnntttttttttttttttttttttttttttttt

SEQ ID NO: 9148 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntagtgtgcnntttttttttttttttttttttttttttttt

SEQ ID NO: 9149 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnctcatgacnntttttttttttttttttttttttttttttt

SEQ ID NO: 9150 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngtatccagnntttttttttttttttttttttttttttttt

SEQ ID NO: 9151 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnacgcctatnntttttttttttttttttttttttttttttt

SEQ ID NO: 9152 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnaacgacctnntttttttttttttttttttttttttttttt

SEQ ID NO: 9153 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnatcaggctnntttttttttttttttttttttttttttttt

SEQ ID NO: 9154 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncaagttcgnntttttttttttttttttttttttttttttt

SEQ ID NO: 9155 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntagccaganntttttttttttttttttttttttttttttt

SEQ ID NO: 9156 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncaatcacgnntttttttttttttttttttttttttttttt

SEQ ID NO: 9157 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnngcaacaagnntttttttttttttttttttttttttttttt

SEQ ID NO: 9158 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncacgacaanntttttttttttttttttttttttttttttt

SEQ ID NO: 9159 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntacggaganntttttttttttttttttttttttttttttt

SEQ ID NO: 9160 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncgacaaganntttttttttttttttttttttttttttttt

SEQ ID NO: 9161 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncgaagtganntttttttttttttttttttttttttttttt

SEQ ID NO: 9162 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnagctggtanntttttttttttttttttttttttttttttt

SEQ ID NO: 9163 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnaactaggcnntttttttttttttttttttttttttttttt

SEQ ID NO: 9164 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncagcaagtnntttttttttttttttttttttttttttttt

SEQ ID NO: 9165 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnacgaggtanntttttttttttttttttttttttttttttt

SEQ ID NO: 9166 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncatcttccnntttttttttttttttttttttttttttttt

SEQ ID NO: 9167 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncctgaatcnntttttttttttttttttttttttttttttt

SEQ ID NO: 9168 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnntgcagactnntttttttttttttttttttttttttttttt

SEQ ID NO: 9169 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnagatgtggnntttttttttttttttttttttttttttttt

SEQ ID NO: 9170 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnagttcgacnntttttttttttttttttttttttttttttt

SEQ ID NO: 9171 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnnacaacctcnntttttttttttttttttttttttttttttt

SEQ ID NO: 9172 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncatggtagnntttttttttttttttttttttttttttttt

SEQ ID NO: 9173 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncgtatctcnntttttttttttttttttttttttttttttt

SEQ ID NO: 9174 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncctagttcnntttttttttttttttttttttttttttttt

SEQ ID NO: 9175 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnacaagaccnncaagagtcnntttttttttttttttttttttttttttttt

SEQ ID NO: 9176 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnaatcggcanntttttttttttttttttttttttttttttt

SEQ ID NO: 9177 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntacggcatnntttttttttttttttttttttttttttttt

SEQ ID NO: 9178 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnttggatcgnntttttttttttttttttttttttttttttt

SEQ ID NO: 9179 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntggaacganntttttttttttttttttttttttttttttt

SEQ ID NO: 9180 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnggcaatcanntttttttttttttttttttttttttttttt

SEQ ID NO: 9181 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngaatccganntttttttttttttttttttttttttttttt

SEQ ID NO: 9182 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnttacggtgnntttttttttttttttttttttttttttttt

SEQ ID NO: 9183 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncatatcggnntttttttttttttttttttttttttttttt

SEQ ID NO: 9184 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncttcggtanntttttttttttttttttttttttttttttt

SEQ ID NO: 9185 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntcctaacgnntttttttttttttttttttttttttttttt

SEQ ID NO: 9186 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngtaagccanntttttttttttttttttttttttttttttt

SEQ ID NO: 9187 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntaaggtggnntttttttttttttttttttttttttttttt

SEQ ID NO: 9188 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnggtaagctnntttttttttttttttttttttttttttttt

SEQ ID NO: 9189 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntgtgtcganntttttttttttttttttttttttttttttt

SEQ ID NO: 9190 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngagcatganntttttttttttttttttttttttttttttt

SEQ ID NO: 9191 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntcgaagtcnntttttttttttttttttttttttttttttt

SEQ ID NO: 9192 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnggtgaacanntttttttttttttttttttttttttttttt

SEQ ID NO: 9193 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnacatgcacnntttttttttttttttttttttttttttttt

SEQ ID NO: 9194 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnccaacagtnntttttttttttttttttttttttttttttt

SEQ ID NO: 9195 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnagaacagcnntttttttttttttttttttttttttttttt

SEQ ID NO: 9196 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngaacacgtnntttttttttttttttttttttttttttttt

SEQ ID NO: 9197 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnggtcttcanntttttttttttttttttttttttttttttt

SEQ ID NO: 9198 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnaggttcagnntttttttttttttttttttttttttttttt

SEQ ID NO: 9199 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnctagagcanntttttttttttttttttttttttttttttt

SEQ ID NO: 9200 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncttctagcnntttttttttttttttttttttttttttttt

SEQ ID NO: 9201 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngagtaacgnntttttttttttttttttttttttttttttt

SEQ ID NO: 9202 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnctaagaggnntttttttttttttttttttttttttttttt

SEQ ID NO: 9203 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnacgtgtagnntttttttttttttttttttttttttttttt

SEQ ID NO: 9204 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnactacaggnntttttttttttttttttttttttttttttt

SEQ ID NO: 9205 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntacaggtcnntttttttttttttttttttttttttttttt

SEQ ID NO: 9206 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnctcacatgnntttttttttttttttttttttttttttttt

SEQ ID NO: 9207 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnactaggagnntttttttttttttttttttttttttttttt

SEQ ID NO: 9208 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnccatagganntttttttttttttttttttttttttttttt

SEQ ID NO: 9209 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnggagaatcnntttttttttttttttttttttttttttttt

SEQ ID NO: 9210 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngccaagaanntttttttttttttttttttttttttttttt

SEQ ID NO: 9211 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnaaggcaagnntttttttttttttttttttttttttttttt

SEQ ID NO: 9212 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnaatgtcgcnntttttttttttttttttttttttttttttt

SEQ ID NO: 9213 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnatggaaccnntttttttttttttttttttttttttttttt

SEQ ID NO: 9214 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnagaggcatnntttttttttttttttttttttttttttttt

SEQ ID NO: 9215 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntgcatagcnntttttttttttttttttttttttttttttt

SEQ ID NO: 9216 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnctaacgganntttttttttttttttttttttttttttttt

SEQ ID NO: 9217 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntatcgaggnntttttttttttttttttttttttttttttt

SEQ ID NO: 9218 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncatagcctnntttttttttttttttttttttttttttttt

SEQ ID NO: 9219 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnatcgagacnntttttttttttttttttttttttttttttt

SEQ ID NO: 9220 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnggaagagtnntttttttttttttttttttttttttttttt

SEQ ID NO: 9221 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnccaagtagnntttttttttttttttttttttttttttttt

SEQ ID NO: 9222 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnctgaacagnntttttttttttttttttttttttttttttt

SEQ ID NO: 9223 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngtaggttcnntttttttttttttttttttttttttttttt

SEQ ID NO: 9224 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngtatggacnntttttttttttttttttttttttttttttt

SEQ ID NO: 9225 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntcgcaacanntttttttttttttttttttttttttttttt

SEQ ID NO: 9226 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnccgctaatnntttttttttttttttttttttttttttttt

SEQ ID NO: 9227 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngattcgcanntttttttttttttttttttttttttttttt

SEQ ID NO: 9228 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncgatggaanntttttttttttttttttttttttttttttt

SEQ ID NO: 9229 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnagcaagganntttttttttttttttttttttttttttttt

SEQ ID NO: 9230 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncgtagcaanntttttttttttttttttttttttttttttt

SEQ ID NO: 9231 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntggcagtanntttttttttttttttttttttttttttttt

SEQ ID NO: 9232 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncggtagttnntttttttttttttttttttttttttttttt

SEQ ID NO: 9233 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntgacttcgnntttttttttttttttttttttttttttttt

SEQ ID NO: 9234 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngagtgcaanntttttttttttttttttttttttttttttt

SEQ ID NO: 9235 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnacggtaacnntttttttttttttttttttttttttttttt

SEQ ID NO: 9236 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnaagtggtgnntttttttttttttttttttttttttttttt

SEQ ID NO: 9237 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnggagacaanntttttttttttttttttttttttttttttt

SEQ ID NO: 9238 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntcaaggacnntttttttttttttttttttttttttttttt

SEQ ID NO: 9239 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnaagagagcnntttttttttttttttttttttttttttttt

SEQ ID NO: 9240 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncgagagatnntttttttttttttttttttttttttttttt

SEQ ID NO: 9241 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnacagatggnntttttttttttttttttttttttttttttt

SEQ ID NO: 9242 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnaggagtcanntttttttttttttttttttttttttttttt

SEQ ID NO: 9243 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncgtgttacnntttttttttttttttttttttttttttttt

SEQ ID NO: 9244 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntagtgtgcnntttttttttttttttttttttttttttttt

SEQ ID NO: 9245 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnctcatgacnntttttttttttttttttttttttttttttt

SEQ ID NO: 9246 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngtatccagnntttttttttttttttttttttttttttttt

SEQ ID NO: 9247 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnacgcctatnntttttttttttttttttttttttttttttt

SEQ ID NO: 9248 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnaacgacctnntttttttttttttttttttttttttttttt

SEQ ID NO: 9249 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnatcaggctnntttttttttttttttttttttttttttttt

SEQ ID NO: 9250 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncaagttcgnntttttttttttttttttttttttttttttt

SEQ ID NO: 9251 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntagccaganntttttttttttttttttttttttttttttt

SEQ ID NO: 9252 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncaatcacgnntttttttttttttttttttttttttttttt

SEQ ID NO: 9253 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnngcaacaagnntttttttttttttttttttttttttttttt

SEQ ID NO: 9254 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncacgacaanntttttttttttttttttttttttttttttt

SEQ ID NO: 9255 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntacggaganntttttttttttttttttttttttttttttt

SEQ ID NO: 9256 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncgacaaganntttttttttttttttttttttttttttttt

SEQ ID NO: 9257 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncgaagtganntttttttttttttttttttttttttttttt

SEQ ID NO: 9258 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnagctggtanntttttttttttttttttttttttttttttt

SEQ ID NO: 9259 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnaactaggcnntttttttttttttttttttttttttttttt

SEQ ID NO: 9260 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncagcaagtnntttttttttttttttttttttttttttttt

SEQ ID NO: 9261 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnacgaggtanntttttttttttttttttttttttttttttt

SEQ ID NO: 9262 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncatcttccnntttttttttttttttttttttttttttttt

SEQ ID NO: 9263 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncctgaatcnntttttttttttttttttttttttttttttt

SEQ ID NO: 9264 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnntgcagactnntttttttttttttttttttttttttttttt

SEQ ID NO: 9265 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnagatgtggnntttttttttttttttttttttttttttttt

SEQ ID NO: 9266 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnagttcgacnntttttttttttttttttttttttttttttt

SEQ ID NO: 9267 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnnacaacctcnntttttttttttttttttttttttttttttt

SEQ ID NO: 9268 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncatggtagnntttttttttttttttttttttttttttttt

SEQ ID NO: 9269 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncgtatctcnntttttttttttttttttttttttttttttt

SEQ ID NO: 9270 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncctagttcnntttttttttttttttttttttttttttttt

SEQ ID NO: 9271 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnngttagacgnncaagagtcnntttttttttttttttttttttttttttttt

SEQ ID NO: 9272 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannaatcggcanntttttttttttttttttttttttttttttt

SEQ ID NO: 9273 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntacggcatnntttttttttttttttttttttttttttttt

SEQ ID NO: 9274 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannttggatcgnntttttttttttttttttttttttttttttt

SEQ ID NO: 9275 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntggaacganntttttttttttttttttttttttttttttt

SEQ ID NO: 9276 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannggcaatcanntttttttttttttttttttttttttttttt

SEQ ID NO: 9277 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngaatccganntttttttttttttttttttttttttttttt

SEQ ID NO: 9278 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannttacggtgnntttttttttttttttttttttttttttttt

SEQ ID NO: 9279 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncatatcggnntttttttttttttttttttttttttttttt

SEQ ID NO: 9280 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncttcggtanntttttttttttttttttttttttttttttt

SEQ ID NO: 9281 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntcctaacgnntttttttttttttttttttttttttttttt

SEQ ID NO: 9282 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngtaagccanntttttttttttttttttttttttttttttt

SEQ ID NO: 9283 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntaaggtggnntttttttttttttttttttttttttttttt

SEQ ID NO: 9284 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannggtaagctnntttttttttttttttttttttttttttttt

SEQ ID NO: 9285 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntgtgtcganntttttttttttttttttttttttttttttt

SEQ ID NO: 9286 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngagcatganntttttttttttttttttttttttttttttt

SEQ ID NO: 9287 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntcgaagtcnntttttttttttttttttttttttttttttt

SEQ ID NO: 9288 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannggtgaacanntttttttttttttttttttttttttttttt

SEQ ID NO: 9289 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannacatgcacnntttttttttttttttttttttttttttttt

SEQ ID NO: 9290 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannccaacagtnntttttttttttttttttttttttttttttt

SEQ ID NO: 9291 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannagaacagcnntttttttttttttttttttttttttttttt

SEQ ID NO: 9292 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngaacacgtnntttttttttttttttttttttttttttttt

SEQ ID NO: 9293 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannggtcttcanntttttttttttttttttttttttttttttt

SEQ ID NO: 9294 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannaggttcagnntttttttttttttttttttttttttttttt

SEQ ID NO: 9295 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannctagagcanntttttttttttttttttttttttttttttt

SEQ ID NO: 9296 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncttctagcnntttttttttttttttttttttttttttttt

SEQ ID NO: 9297 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngagtaacgnntttttttttttttttttttttttttttttt

SEQ ID NO: 9298 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannctaagaggnntttttttttttttttttttttttttttttt

SEQ ID NO: 9299 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannacgtgtagnntttttttttttttttttttttttttttttt

SEQ ID NO: 9300 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannactacaggnntttttttttttttttttttttttttttttt

SEQ ID NO: 9301 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntacaggtcnntttttttttttttttttttttttttttttt

SEQ ID NO: 9302 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannctcacatgnntttttttttttttttttttttttttttttt

SEQ ID NO: 9303 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannactaggagnntttttttttttttttttttttttttttttt

SEQ ID NO: 9304 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannccatagganntttttttttttttttttttttttttttttt

SEQ ID NO: 9305 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannggagaatcnntttttttttttttttttttttttttttttt

SEQ ID NO: 9306 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngccaagaanntttttttttttttttttttttttttttttt

SEQ ID NO: 9307 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannaaggcaagnntttttttttttttttttttttttttttttt

SEQ ID NO: 9308 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannaatgtcgcnntttttttttttttttttttttttttttttt

SEQ ID NO: 9309 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannatggaaccnntttttttttttttttttttttttttttttt

SEQ ID NO: 9310 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannagaggcatnntttttttttttttttttttttttttttttt

SEQ ID NO: 9311 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntgcatagcnntttttttttttttttttttttttttttttt

SEQ ID NO: 9312 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannctaacgganntttttttttttttttttttttttttttttt

SEQ ID NO: 9313 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntatcgaggnntttttttttttttttttttttttttttttt

SEQ ID NO: 9314 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncatagcctnntttttttttttttttttttttttttttttt

SEQ ID NO: 9315 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannatcgagacnntttttttttttttttttttttttttttttt

SEQ ID NO: 9316 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannggaagagtnntttttttttttttttttttttttttttttt

SEQ ID NO: 9317 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannccaagtagnntttttttttttttttttttttttttttttt

SEQ ID NO: 9318 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannctgaacagnntttttttttttttttttttttttttttttt

SEQ ID NO: 9319 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngtaggttcnntttttttttttttttttttttttttttttt

SEQ ID NO: 9320 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngtatggacnntttttttttttttttttttttttttttttt

SEQ ID NO: 9321 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntcgcaacanntttttttttttttttttttttttttttttt

SEQ ID NO: 9322 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannccgctaatnntttttttttttttttttttttttttttttt

SEQ ID NO: 9323 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngattcgcanntttttttttttttttttttttttttttttt

SEQ ID NO: 9324 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncgatggaanntttttttttttttttttttttttttttttt

SEQ ID NO: 9325 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannagcaagganntttttttttttttttttttttttttttttt

SEQ ID NO: 9326 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncgtagcaanntttttttttttttttttttttttttttttt

SEQ ID NO: 9327 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntggcagtanntttttttttttttttttttttttttttttt

SEQ ID NO: 9328 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncggtagttnntttttttttttttttttttttttttttttt

SEQ ID NO: 9329 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntgacttcgnntttttttttttttttttttttttttttttt

SEQ ID NO: 9330 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngagtgcaanntttttttttttttttttttttttttttttt

SEQ ID NO: 9331 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannacggtaacnntttttttttttttttttttttttttttttt

SEQ ID NO: 9332 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannaagtggtgnntttttttttttttttttttttttttttttt

SEQ ID NO: 9333 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannggagacaanntttttttttttttttttttttttttttttt

SEQ ID NO: 9334 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntcaaggacnntttttttttttttttttttttttttttttt

SEQ ID NO: 9335 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannaagagagcnntttttttttttttttttttttttttttttt

SEQ ID NO: 9336 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncgagagatnntttttttttttttttttttttttttttttt

SEQ ID NO: 9337 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannacagatggnntttttttttttttttttttttttttttttt

SEQ ID NO: 9338 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannaggagtcanntttttttttttttttttttttttttttttt

SEQ ID NO: 9339 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncgtgttacnntttttttttttttttttttttttttttttt

SEQ ID NO: 9340 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntagtgtgcnntttttttttttttttttttttttttttttt

SEQ ID NO: 9341 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannctcatgacnntttttttttttttttttttttttttttttt

SEQ ID NO: 9342 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngtatccagnntttttttttttttttttttttttttttttt

SEQ ID NO: 9343 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannacgcctatnntttttttttttttttttttttttttttttt

SEQ ID NO: 9344 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannaacgacctnntttttttttttttttttttttttttttttt

SEQ ID NO: 9345 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannatcaggctnntttttttttttttttttttttttttttttt

SEQ ID NO: 9346 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncaagttcgnntttttttttttttttttttttttttttttt

SEQ ID NO: 9347 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntagccaganntttttttttttttttttttttttttttttt

SEQ ID NO: 9348 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncaatcacgnntttttttttttttttttttttttttttttt

SEQ ID NO: 9349 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanngcaacaagnntttttttttttttttttttttttttttttt

SEQ ID NO: 9350 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncacgacaanntttttttttttttttttttttttttttttt

SEQ ID NO: 9351 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntacggaganntttttttttttttttttttttttttttttt

SEQ ID NO: 9352 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncgacaaganntttttttttttttttttttttttttttttt

SEQ ID NO: 9353 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncgaagtganntttttttttttttttttttttttttttttt

SEQ ID NO: 9354 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannagctggtanntttttttttttttttttttttttttttttt

SEQ ID NO: 9355 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannaactaggcnntttttttttttttttttttttttttttttt

SEQ ID NO: 9356 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncagcaagtnntttttttttttttttttttttttttttttt

SEQ ID NO: 9357 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannacgaggtanntttttttttttttttttttttttttttttt

SEQ ID NO: 9358 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncatcttccnntttttttttttttttttttttttttttttt

SEQ ID NO: 9359 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncctgaatcnntttttttttttttttttttttttttttttt

SEQ ID NO: 9360 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanntgcagactnntttttttttttttttttttttttttttttt

SEQ ID NO: 9361 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannagatgtggnntttttttttttttttttttttttttttttt

SEQ ID NO: 9362 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannagttcgacnntttttttttttttttttttttttttttttt

SEQ ID NO: 9363 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtannacaacctcnntttttttttttttttttttttttttttttt

SEQ ID NO: 9364 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncatggtagnntttttttttttttttttttttttttttttt

SEQ ID NO: 9365 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncgtatctcnntttttttttttttttttttttttttttttt

SEQ ID NO: 9366 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncctagttcnntttttttttttttttttttttttttttttt

SEQ ID NO: 9367 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnnctggtgtanncaagagtcnntttttttttttttttttttttttttttttt

SEQ ID NO: 9368 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnaatcggcanntttttttttttttttttttttttttttttt

SEQ ID NO: 9369 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntacggcatnntttttttttttttttttttttttttttttt

SEQ ID NO: 9370 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnttggatcgnntttttttttttttttttttttttttttttt

SEQ ID NO: 9371 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntggaacganntttttttttttttttttttttttttttttt

SEQ ID NO: 9372 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnggcaatcanntttttttttttttttttttttttttttttt

SEQ ID NO: 9373 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngaatccganntttttttttttttttttttttttttttttt

SEQ ID NO: 9374 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnttacggtgnntttttttttttttttttttttttttttttt

SEQ ID NO: 9375 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncatatcggnntttttttttttttttttttttttttttttt

SEQ ID NO: 9376 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncttcggtanntttttttttttttttttttttttttttttt

SEQ ID NO: 9377 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntcctaacgnntttttttttttttttttttttttttttttt

SEQ ID NO: 9378 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngtaagccanntttttttttttttttttttttttttttttt

SEQ ID NO: 9379 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntaaggtggnntttttttttttttttttttttttttttttt

SEQ ID NO: 9380 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnggtaagctnntttttttttttttttttttttttttttttt

SEQ ID NO: 9381 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntgtgtcganntttttttttttttttttttttttttttttt

SEQ ID NO: 9382 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngagcatganntttttttttttttttttttttttttttttt

SEQ ID NO: 9383 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntcgaagtcnntttttttttttttttttttttttttttttt

SEQ ID NO: 9384 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnggtgaacanntttttttttttttttttttttttttttttt

SEQ ID NO: 9385 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnacatgcacnntttttttttttttttttttttttttttttt

SEQ ID NO: 9386 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnccaacagtnntttttttttttttttttttttttttttttt

SEQ ID NO: 9387 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnagaacagcnntttttttttttttttttttttttttttttt

SEQ ID NO: 9388 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngaacacgtnntttttttttttttttttttttttttttttt

SEQ ID NO: 9389 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnggtcttcanntttttttttttttttttttttttttttttt

SEQ ID NO: 9390 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnaggttcagnntttttttttttttttttttttttttttttt

SEQ ID NO: 9391 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnctagagcanntttttttttttttttttttttttttttttt

SEQ ID NO: 9392 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncttctagcnntttttttttttttttttttttttttttttt

SEQ ID NO: 9393 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngagtaacgnntttttttttttttttttttttttttttttt

SEQ ID NO: 9394 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnctaagaggnntttttttttttttttttttttttttttttt

SEQ ID NO: 9395 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnacgtgtagnntttttttttttttttttttttttttttttt

SEQ ID NO: 9396 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnactacaggnntttttttttttttttttttttttttttttt

SEQ ID NO: 9397 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntacaggtcnntttttttttttttttttttttttttttttt

SEQ ID NO: 9398 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnctcacatgnntttttttttttttttttttttttttttttt

SEQ ID NO: 9399 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnactaggagnntttttttttttttttttttttttttttttt

SEQ ID NO: 9400 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnccatagganntttttttttttttttttttttttttttttt

SEQ ID NO: 9401 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnggagaatcnntttttttttttttttttttttttttttttt

SEQ ID NO: 9402 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngccaagaanntttttttttttttttttttttttttttttt

SEQ ID NO: 9403 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnaaggcaagnntttttttttttttttttttttttttttttt

SEQ ID NO: 9404 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnaatgtcgcnntttttttttttttttttttttttttttttt

SEQ ID NO: 9405 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnatggaaccnntttttttttttttttttttttttttttttt

SEQ ID NO: 9406 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnagaggcatnntttttttttttttttttttttttttttttt

SEQ ID NO: 9407 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntgcatagcnntttttttttttttttttttttttttttttt

SEQ ID NO: 9408 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnctaacgganntttttttttttttttttttttttttttttt

SEQ ID NO: 9409 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntatcgaggnntttttttttttttttttttttttttttttt

SEQ ID NO: 9410 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncatagcctnntttttttttttttttttttttttttttttt

SEQ ID NO: 9411 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnatcgagacnntttttttttttttttttttttttttttttt

SEQ ID NO: 9412 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnggaagagtnntttttttttttttttttttttttttttttt

SEQ ID NO: 9413 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnccaagtagnntttttttttttttttttttttttttttttt

SEQ ID NO: 9414 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnctgaacagnntttttttttttttttttttttttttttttt

SEQ ID NO: 9415 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngtaggttcnntttttttttttttttttttttttttttttt

SEQ ID NO: 9416 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngtatggacnntttttttttttttttttttttttttttttt

SEQ ID NO: 9417 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntcgcaacanntttttttttttttttttttttttttttttt

SEQ ID NO: 9418 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnccgctaatnntttttttttttttttttttttttttttttt

SEQ ID NO: 9419 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngattcgcanntttttttttttttttttttttttttttttt

SEQ ID NO: 9420 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncgatggaanntttttttttttttttttttttttttttttt

SEQ ID NO: 9421 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnagcaagganntttttttttttttttttttttttttttttt

SEQ ID NO: 9422 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncgtagcaanntttttttttttttttttttttttttttttt

SEQ ID NO: 9423 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntggcagtanntttttttttttttttttttttttttttttt

SEQ ID NO: 9424 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncggtagttnntttttttttttttttttttttttttttttt

SEQ ID NO: 9425 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntgacttcgnntttttttttttttttttttttttttttttt

SEQ ID NO: 9426 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngagtgcaanntttttttttttttttttttttttttttttt

SEQ ID NO: 9427 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnacggtaacnntttttttttttttttttttttttttttttt

SEQ ID NO: 9428 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnaagtggtgnntttttttttttttttttttttttttttttt

SEQ ID NO: 9429 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnggagacaanntttttttttttttttttttttttttttttt

SEQ ID NO: 9430 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntcaaggacnntttttttttttttttttttttttttttttt

SEQ ID NO: 9431 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnaagagagcnntttttttttttttttttttttttttttttt

SEQ ID NO: 9432 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncgagagatnntttttttttttttttttttttttttttttt

SEQ ID NO: 9433 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnacagatggnntttttttttttttttttttttttttttttt

SEQ ID NO: 9434 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnaggagtcanntttttttttttttttttttttttttttttt

SEQ ID NO: 9435 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncgtgttacnntttttttttttttttttttttttttttttt

SEQ ID NO: 9436 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntagtgtgcnntttttttttttttttttttttttttttttt

SEQ ID NO: 9437 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnctcatgacnntttttttttttttttttttttttttttttt

SEQ ID NO: 9438 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngtatccagnntttttttttttttttttttttttttttttt

SEQ ID NO: 9439 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnacgcctatnntttttttttttttttttttttttttttttt

SEQ ID NO: 9440 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnaacgacctnntttttttttttttttttttttttttttttt

SEQ ID NO: 9441 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnatcaggctnntttttttttttttttttttttttttttttt

SEQ ID NO: 9442 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncaagttcgnntttttttttttttttttttttttttttttt

SEQ ID NO: 9443 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntagccaganntttttttttttttttttttttttttttttt

SEQ ID NO: 9444 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncaatcacgnntttttttttttttttttttttttttttttt

SEQ ID NO: 9445 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnngcaacaagnntttttttttttttttttttttttttttttt

SEQ ID NO: 9446 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncacgacaanntttttttttttttttttttttttttttttt

SEQ ID NO: 9447 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntacggaganntttttttttttttttttttttttttttttt

SEQ ID NO: 9448 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncgacaaganntttttttttttttttttttttttttttttt

SEQ ID NO: 9449 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncgaagtganntttttttttttttttttttttttttttttt

SEQ ID NO: 9450 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnagctggtanntttttttttttttttttttttttttttttt

SEQ ID NO: 9451 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnaactaggcnntttttttttttttttttttttttttttttt

SEQ ID NO: 9452 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncagcaagtnntttttttttttttttttttttttttttttt

SEQ ID NO: 9453 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnacgaggtanntttttttttttttttttttttttttttttt

SEQ ID NO: 9454 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncatcttccnntttttttttttttttttttttttttttttt

SEQ ID NO: 9455 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncctgaatcnntttttttttttttttttttttttttttttt

SEQ ID NO: 9456 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnntgcagactnntttttttttttttttttttttttttttttt

SEQ ID NO: 9457 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnagatgtggnntttttttttttttttttttttttttttttt

SEQ ID NO: 9458 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnagttcgacnntttttttttttttttttttttttttttttt

SEQ ID NO: 9459 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnnacaacctcnntttttttttttttttttttttttttttttt

SEQ ID NO: 9460 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncatggtagnntttttttttttttttttttttttttttttt

SEQ ID NO: 9461 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncgtatctcnntttttttttttttttttttttttttttttt

SEQ ID NO: 9462 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncctagttcnntttttttttttttttttttttttttttttt

SEQ ID NO: 9463 - DNA, 84 bp, Artificial sequence
  Synthetic
  misc_feature (33)..(34): n is a, c, g, or t
  misc_feature (43)..(44): n is a, c, g, or t
  misc_feature (53)..(54): n is a, c, g, or t
tttttttaagcagtggtatcaacgcagagtacnntagacgacnncaagagtcnntttttttttttttttttttttttttttttt

SEQ ID NO: 9464 - DNA, 54 bp, Artificial sequence
  Synthetic
aggtaaggtaatacgactcactataggggttcagagttctacagtccgacgatc

SEQ ID NO: 9465 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnncgtgatnnnnnn

SEQ ID NO: 9466 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnnacatcgnnnnnn

SEQ ID NO: 9467 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnngcctaannnnnn

SEQ ID NO: 9468 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnntggtcannnnnn

SEQ ID NO: 9469 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnncactgtnnnnnn

SEQ ID NO: 9470 - DNA, 50 bp, Artificial sequence
  Synthetic
aatgatacggcgaccaccgagatctacacgttcagagttctacagtccga

SEQ ID NO: 9471 - DNA, 63 bp, Artificial sequence
  Synthetic
caagcagaagacggcatacgagatcgtgatgtgactggagttccttggcacccgagaattcca

SEQ ID NO: 9472 - DNA, 41 bp, Artificial sequence
  Synthetic
caggtcaaccagagagatcgtcggactgtagaactctgaac

SEQ ID NO: 9473 - DNA, 41 bp, Artificial sequence
  Synthetic
caggtcaaagtacgcgatcgtcggactgtagaactctgaac

SEQ ID NO: 9474 - DNA, 41 bp, Artificial sequence
  Synthetic
caggtcgtttggcatgatcgtcggactgtagaactctgaac

SEQ ID NO: 9475 - DNA, 41 bp, Artificial sequence
  Synthetic
caggtcaagtgaggtgatcgtcggactgtagaactctgaac

SEQ ID NO: 9476 - DNA, 41 bp, Artificial sequence
  Synthetic
caggtcacgttagctgatcgtcggactgtagaactctgaac

SEQ ID NO: 9477 - DNA, 41 bp, Artificial sequence
  Synthetic
caggtcgtgctagaggatcgtcggactgtagaactctgaac

SEQ ID NO: 9478 - DNA, 41 bp, Artificial sequence
  Synthetic
caggtcgtcctgtgtgatcgtcggactgtagaactctgaac

SEQ ID NO: 9479 - DNA, 41 bp, Artificial sequence
  Synthetic
caggtctctacggcagatcgtcggactgtagaactctgaac

SEQ ID NO: 9480 - DNA, 41 bp, Artificial sequence
  Synthetic
caggtcacagggcttgatcgtcggactgtagaactctgaac

SEQ ID NO: 9481 - DNA, 41 bp, Artificial sequence
  Synthetic
caggtcgtgcgttatgatcgtcggactgtagaactctgaac

SEQ ID NO: 9482 - DNA, 41 bp, Artificial sequence
  Synthetic
caggtcgggtaagtagatcgtcggactgtagaactctgaac

SEQ ID NO: 9483 - DNA, 41 bp, Artificial sequence
  Synthetic
caggtctcccttagggatcgtcggactgtagaactctgaac

SEQ ID NO: 9484 - DNA, 41 bp, Artificial sequence
  Synthetic
caggtccaagttggtgatcgtcggactgtagaactctgaac

SEQ ID NO: 9485 - DNA, 41 bp, Artificial sequence
  Synthetic
caggtcttctcactcgatcgtcggactgtagaactctgaac

SEQ ID NO: 9486 - DNA, 41 bp, Artificial sequence
  Synthetic
caggtctcccactctgatcgtcggactgtagaactctgaac

SEQ ID NO: 9487 - DNA, 41 bp, Artificial sequence
  Synthetic
caggtccggtataccgatcgtcggactgtagaactctgaac

SEQ ID NO: 9488 - DNA, 41 bp, Artificial sequence
  Synthetic
caggtcaggcatgtggatcgtcggactgtagaactctgaac

SEQ ID NO: 9489 - DNA, 41 bp, Artificial sequence
  Synthetic
caggtccccagattggatcgtcggactgtagaactctgaac

SEQ ID NO: 9490 - DNA, 41 bp, Artificial sequence
  Synthetic
caggtcttcccttgagatcgtcggactgtagaactctgaac

SEQ ID NO: 9491 - DNA, 41 bp, Artificial sequence
  Synthetic
caggtcgttgtacgagatcgtcggactgtagaactctgaac

SEQ ID NO: 9492 - DNA, 41 bp, Artificial sequence
  Synthetic
caggtctgcttgcaggatcgtcggactgtagaactctgaac

SEQ ID NO: 9493 - DNA, 41 bp, Artificial sequence
  Synthetic
caggtcggcctcattgatcgtcggactgtagaactctgaac

SEQ ID NO: 9494 - DNA, 41 bp, Artificial sequence
  Synthetic
caggtcaacagcctagatcgtcggactgtagaactctgaac

SEQ ID NO: 9495 - DNA, 41 bp, Artificial sequence
  Synthetic
caggtcgatgcaatggatcgtcggactgtagaactctgaac

SEQ ID NO: 9496 - DNA, 41 bp, Artificial sequence
  Synthetic
caggtcgaaggaacggatcgtcggactgtagaactctgaac

SEQ ID NO: 9497 - DNA, 41 bp, Artificial sequence
  Synthetic
caggtccagccacttgatcgtcggactgtagaactctgaac

SEQ ID NO: 9498 - DNA, 41 bp, Artificial sequence
  Synthetic
caggtcctctgcttcgatcgtcggactgtagaactctgaac

SEQ ID NO: 9499 - DNA, 41 bp, Artificial sequence
  Synthetic
caggtcggcttatgagatcgtcggactgtagaactctgaac

SEQ ID NO: 9500 - DNA, 41 bp, Artificial sequence
  Synthetic
caggtcctagtcctcgatcgtcggactgtagaactctgaac

SEQ ID NO: 9501 - DNA, 41 bp, Artificial sequence
  Synthetic
caggtcctagaggaggatcgtcggactgtagaactctgaac

SEQ ID NO: 9502 - DNA, 41 bp, Artificial sequence
  Synthetic
caggtcagctttaccgatcgtcggactgtagaactctgaac

SEQ ID NO: 9503 - DNA, 41 bp, Artificial sequence
  Synthetic
caggtcgtccatgaagatcgtcggactgtagaactctgaac

SEQ ID NO: 9504 - DNA, 41 bp, Artificial sequence
  Synthetic
caggtcctcgaacctgatcgtcggactgtagaactctgaac

SEQ ID NO: 9505 - DNA, 41 bp, Artificial sequence
  Synthetic
caggtccattgtacggatcgtcggactgtagaactctgaac

SEQ ID NO: 9506 - DNA, 41 bp, Artificial sequence
  Synthetic
caggtcttgaacgctgatcgtcggactgtagaactctgaac

SEQ ID NO: 9507 - DNA, 41 bp, Artificial sequence
  Synthetic
caggtctacgtcatggatcgtcggactgtagaactctgaac

SEQ ID NO: 9508 - DNA, 41 bp, Artificial sequence
  Synthetic
caggtcaagccgttagatcgtcggactgtagaactctgaac

SEQ ID NO: 9509 - DNA, 41 bp, Artificial sequence
  Synthetic
caggtccggacgtatgatcgtcggactgtagaactctgaac

SEQ ID NO: 9510 - DNA, 41 bp, Artificial sequence
  Synthetic
caggtctcgttaccggatcgtcggactgtagaactctgaac

SEQ ID NO: 9511 - DNA, 41 bp, Artificial sequence
  Synthetic
caggtcatcccccatgatcgtcggactgtagaactctgaac

SEQ ID NO: 9512 - DNA, 41 bp, Artificial sequence
  Synthetic
caggtccagacgattgatcgtcggactgtagaactctgaac

SEQ ID NO: 9513 - DNA, 41 bp, Artificial sequence
  Synthetic
caggtcatcgatcccgatcgtcggactgtagaactctgaac

SEQ ID NO: 9514 - DNA, 41 bp, Artificial sequence
  Synthetic
caggtccctgaggatgatcgtcggactgtagaactctgaac

SEQ ID NO: 9515 - DNA, 41 bp, Artificial sequence
  Synthetic
caggtcagctctttggatcgtcggactgtagaactctgaac

SEQ ID NO: 9516 - DNA, 41 bp, Artificial sequence
  Synthetic
caggtcggaatacgggatcgtcggactgtagaactctgaac

SEQ ID NO: 9517 - DNA, 41 bp, Artificial sequence
  Synthetic
caggtcctatcctgggatcgtcggactgtagaactctgaac

SEQ ID NO: 9518 - DNA, 41 bp, Artificial sequence
  Synthetic
caggtcggttgtagtgatcgtcggactgtagaactctgaac

SEQ ID NO: 9519 - DNA, 41 bp, Artificial sequence
  Synthetic
caggtcgaacgtagcgatcgtcggactgtagaactctgaac

SEQ ID NO: 9520 - DNA, 40 bp, Artificial sequence
  Synthetic
caggtcgtctatcggatcgtcggactgtagaactctgaac

SEQ ID NO: 9521 - DNA, 40 bp, Artificial sequence
  Synthetic
caggtctacgagtggatcgtcggactgtagaactctgaac

SEQ ID NO: 9522 - DNA, 40 bp, Artificial sequence
  Synthetic
caggtctcatgtcggatcgtcggactgtagaactctgaac

SEQ ID NO: 9523 - DNA, 40 bp, Artificial sequence
  Synthetic
caggtcaaacacccgatcgtcggactgtagaactctgaac

SEQ ID NO: 9524 - DNA, 40 bp, Artificial sequence
  Synthetic
caggtcactagtccgatcgtcggactgtagaactctgaac

SEQ ID NO: 9525 - DNA, 40 bp, Artificial sequence
  Synthetic
caggtccgaggaatgatcgtcggactgtagaactctgaac

SEQ ID NO: 9526 - DNA, 40 bp, Artificial sequence
  Synthetic
caggtcacaatggcgatcgtcggactgtagaactctgaac

SEQ ID NO: 9527 - DNA, 40 bp, Artificial sequence
  Synthetic
caggtctaggtctcgatcgtcggactgtagaactctgaac

SEQ ID NO: 9528 - DNA, 40 bp, Artificial sequence
  Synthetic
caggtctctgtgaggatcgtcggactgtagaactctgaac

SEQ ID NO: 9529 - DNA, 40 bp, Artificial sequence
  Synthetic
caggtcgggattgagatcgtcggactgtagaactctgaac

SEQ ID NO: 9530 - DNA, 40 bp, Artificial sequence
  Synthetic
caggtcaactctgggatcgtcggactgtagaactctgaac

SEQ ID NO: 9531 - DNA, 40 bp, Artificial sequence
  Synthetic
caggtcaaacgcgtgatcgtcggactgtagaactctgaac

SEQ ID NO: 9532 - DNA, 40 bp, Artificial sequence
  Synthetic
caggtctcctacgagatcgtcggactgtagaactctgaac

SEQ ID NO: 9533 - DNA, 40 bp, Artificial sequence
  Synthetic
caggtctagcaggtgatcgtcggactgtagaactctgaac

SEQ ID NO: 9534 - DNA, 40 bp, Artificial sequence
  Synthetic
caggtccctgcattgatcgtcggactgtagaactctgaac

SEQ ID NO: 9535 - DNA, 40 bp, Artificial sequence
  Synthetic
caggtcgtgatgcagatcgtcggactgtagaactctgaac

SEQ ID NO: 9536 - DNA, 40 bp, Artificial sequence
  Synthetic
caggtccgattcaggatcgtcggactgtagaactctgaac

SEQ ID NO: 9537 - DNA, 40 bp, Artificial sequence
  Synthetic
caggtcaggatgacgatcgtcggactgtagaactctgaac

SEQ ID NO: 9538 - DNA, 40 bp, Artificial sequence
  Synthetic
caggtcaggccatagatcgtcggactgtagaactctgaac

SEQ ID NO: 9539 - DNA, 40 bp, Artificial sequence
  Synthetic
caggtcgcttgcttgatcgtcggactgtagaactctgaac

SEQ ID NO: 9540 - DNA, 40 bp, Artificial sequence
  Synthetic
caggtctcccaagtgatcgtcggactgtagaactctgaac

SEQ ID NO: 9541 - DNA, 40 bp, Artificial sequence
  Synthetic
caggtctcaaggcagatcgtcggactgtagaactctgaac

SEQ ID NO: 9542 - DNA, 40 bp, Artificial sequence
  Synthetic
caggtcacgaggtagatcgtcggactgtagaactctgaac

SEQ ID NO: 9543 - DNA, 40 bp, Artificial sequence
  Synthetic
caggtcggaacgaagatcgtcggactgtagaactctgaac

SEQ ID NO: 9544 - DNA, 40 bp, Artificial sequence
  Synthetic
caggtcaatcccaggatcgtcggactgtagaactctgaac

SEQ ID NO: 9545 - DNA, 40 bp, Artificial sequence
  Synthetic
caggtccgataagggatcgtcggactgtagaactctgaac

SEQ ID NO: 9546 - DNA, 40 bp, Artificial sequence
  Synthetic
caggtctatcgcgagatcgtcggactgtagaactctgaac

SEQ ID NO: 9547 - DNA, 40 bp, Artificial sequence
  Synthetic
caggtccgcataacgatcgtcggactgtagaactctgaac

SEQ ID NO: 9548 - DNA, 40 bp, Artificial sequence
  Synthetic
caggtcgtgcagttgatcgtcggactgtagaactctgaac

SEQ ID NO: 9549 - DNA, 40 bp, Artificial sequence
  Synthetic
caggtcagaacgctgatcgtcggactgtagaactctgaac

SEQ ID NO: 9550 - DNA, 40 bp, Artificial sequence
  Synthetic
caggtctagaggtcgatcgtcggactgtagaactctgaac

SEQ ID NO: 9551 - DNA, 40 bp, Artificial sequence
  Synthetic
caggtcctgtgatggatcgtcggactgtagaactctgaac

SEQ ID NO: 9552 - DNA, 40 bp, Artificial sequence
  Synthetic
caggtctagagccagatcgtcggactgtagaactctgaac

SEQ ID NO: 9553 - DNA, 40 bp, Artificial sequence
  Synthetic
caggtccttgatgcgatcgtcggactgtagaactctgaac

SEQ ID NO: 9554 - DNA, 40 bp, Artificial sequence
  Synthetic
caggtcttcgtgtcgatcgtcggactgtagaactctgaac

SEQ ID NO: 9555 - DNA, 40 bp, Artificial sequence
  Synthetic
caggtctatctgcggatcgtcggactgtagaactctgaac

SEQ ID NO: 9556 - DNA, 40 bp, Artificial sequence
  Synthetic
caggtctggtaggagatcgtcggactgtagaactctgaac

SEQ ID NO: 9557 - DNA, 40 bp, Artificial sequence
  Synthetic
caggtccctagacagatcgtcggactgtagaactctgaac

SEQ ID NO: 9558 - DNA, 40 bp, Artificial sequence
  Synthetic
caggtcagtcaacggatcgtcggactgtagaactctgaac

SEQ ID NO: 9559 - DNA, 40 bp, Artificial sequence
  Synthetic
caggtcaagggtgagatcgtcggactgtagaactctgaac

SEQ ID NO: 9560 - DNA, 40 bp, Artificial sequence
  Synthetic
caggtccttcacacgatcgtcggactgtagaactctgaac

SEQ ID NO: 9561 - DNA, 40 bp, Artificial sequence
  Synthetic
caggtcaggttgctgatcgtcggactgtagaactctgaac

SEQ ID NO: 9562 - DNA, 40 bp, Artificial sequence
  Synthetic
caggtcacccgaaagatcgtcggactgtagaactctgaac

SEQ ID NO: 9563 - DNA, 40 bp, Artificial sequence
  Synthetic
caggtcgaaaaggggatcgtcggactgtagaactctgaac

SEQ ID NO: 9564 - DNA, 40 bp, Artificial sequence
  Synthetic
caggtcacttcccagatcgtcggactgtagaactctgaac

SEQ ID NO: 9565 - DNA, 40 bp, Artificial sequence
  Synthetic
caggtctgctgcatgatcgtcggactgtagaactctgaac

SEQ ID NO: 9566 - DNA, 40 bp, Artificial sequence
  Synthetic
caggtcattcctgggatcgtcggactgtagaactctgaac

SEQ ID NO: 9567 - DNA, 40 bp, Artificial sequence
  Synthetic
caggtccagaactcgatcgtcggactgtagaactctgaac

SEQ ID NO: 9568 - DNA, 68 bp, Artificial sequence
  Synthetic
aaaaaaaaaaaaaaaaaaaaaaaaaggtgatacaggtcaaaaaaaaagatcgtcggactgtagaactc

SEQ ID NO: 9569 - DNA, 68 bp, Artificial sequence
  Synthetic
aaaaaaaaaaaaaaaaaaaaaaaaatgaatgccaggtcaaaaaaaaagatcgtcggactgtagaactc

SEQ ID NO: 9570 - DNA, 68 bp, Artificial sequence
  Synthetic
aaaaaaaaaaaaaaaaaaaaaaaaatgccaaacaggtcaaaaaaaaagatcgtcggactgtagaactc

SEQ ID NO: 9571 - DNA, 68 bp, Artificial sequence
  Synthetic
aaaaaaaaaaaaaaaaaaaaaaaaaacagaagcaggtcaaaaaaaaagatcgtcggactgtagaactc

SEQ ID NO: 9572 - DNA, 68 bp, Artificial sequence
  Synthetic
aaaaaaaaaaaaaaaaaaaaaaaaacactggacaggtcaaaaaaaaagatcgtcggactgtagaactc

SEQ ID NO: 9573 - DNA, 68 bp, Artificial sequence
  Synthetic
aaaaaaaaaaaaaaaaaaaaaaaaacgatgatcaggtcaaaaaaaaagatcgtcggactgtagaactc

SEQ ID NO: 9574 - DNA, 68 bp, Artificial sequence
  Synthetic
aaaaaaaaaaaaaaaaaaaaaaaaagtgtccacaggtcaaaaaaaaagatcgtcggactgtagaactc

SEQ ID NO: 9575 - DNA, 68 bp, Artificial sequence
  Synthetic
aaaaaaaaaaaaaaaaaaaaaaaaatcctcttcaggtcaaaaaaaaagatcgtcggactgtagaactc

SEQ ID NO: 9576 - DNA, 68 bp, Artificial sequence
  Synthetic
aaaaaaaaaaaaaaaaaaaaaaaaagtgcagtcaggtcaaaaaaaaagatcgtcggactgtagaactc

SEQ ID NO: 9577 - DNA, 68 bp, Artificial sequence
  Synthetic
aaaaaaaaaaaaaaaaaaaaaaaaaaggtagacaggtcaaaaaaaaagatcgtcggactgtagaactc

SEQ ID NO: 9578 - DNA, 54 bp, Artificial sequence; identical to SEQ ID NO: 9464
  Synthetic

SEQ ID NO: 9579 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnncgtcatnnnnnn

SEQ ID NO: 9580 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnntacccannnnnn

SEQ ID NO: 9581 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnngccattnnnnnn

SEQ ID NO: 9582 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnngagtacnnnnnn

SEQ ID NO: 9583 - DNA, 42 bp, Artificial sequence
  Synthetic
  misc_feature (23)..(30): n is a, c, g, or t
  misc_feature (37)..(42): n is a, c, g, or t
gccttggcacccgagaattccannnnnnnnagagtcnnnnnn

SEQ ID NO: 9584 - DNA, 50 bp, Artificial sequence; identical to SEQ ID NO: 9470
  Synthetic

SEQ ID NO: 9585 - DNA, 63 bp, Artificial sequence
  Synthetic
caagcagaagacggcatacgagatacatcggtgactggagttccttggcacccgagaattcca

SEQ ID NO: 9586 - DNA, 41 bp, Artificial sequence
  Synthetic
caggtcctgatcgatgatcgtcggactgtagaactctgaac

SEQ ID NO: 9587 - DNA, 41 bp, Artificial sequence
  Synthetic
caggtcgtgtagacagatcgtcggactgtagaactctgaac

SEQ ID NO: 9588 - DNA, 41 bp, Artificial sequence
  Synthetic
caggtccattgttccgatcgtcggactgtagaactctgaac

SEQ ID NO: 9589 - DNA, 41 bp, Artificial sequence
  Synthetic
caggtccttgactacgatcgtcggactgtagaactctgaac

SEQ ID NO: 9590 - DNA, 41 bp, Artificial sequence
  Synthetic
caggtcaccgtttcggatcgtcggactgtagaactctgaac

SEQ ID NO: 9591 - DNA, 41 bp, Artificial sequence
  Synthetic
caggtcaaggaccgtgatcgtcggactgtagaactctgaac

SEQ ID NO: 9592 - DNA, 41 bp, Artificial sequence
  Synthetic
caggtctcactatgcgatcgtcggactgtagaactctgaac

SEQ ID NO: 9593 - DNA, 41 bp, Artificial sequence
  Synthetic
caggtcctgcaatgggatcgtcggactgtagaactctgaac

SEQ ID NO: 9594 - DNA, 41 bp, Artificial sequence
  Synthetic
caggtctgagtcgtcgatcgtcggactgtagaactctgaac

SEQ ID NO: 9595 - DNA, 41 bp, Artificial sequence
  Synthetic
caggtcctcacactagatcgtcggactgtagaactctgaac

SEQ ID NO: 9596 - DNA, 41 bp, Artificial sequence
  Synthetic
caggtcttaccccctgatcgtcggactgtagaactctgaac

SEQ ID NO: 9597 - DNA, 41 bp, Artificial sequence
  Synthetic
caggtcccaagtagagatcgtcggactgtagaactctgaac

SEQ ID NO: 9598 - DNA, 41 bp, Artificial sequence
  Synthetic
caggtcatagcgcacgatcgtcggactgtagaactctgaac

SEQ ID NO: 9599 - DNA, 41 bp, Artificial sequence
  Synthetic
caggtctgacgtacggatcgtcggactgtagaactctgaac

SEQ ID NO: 9600 - DNA, 41 bp, Artificial sequence
  Synthetic
caggtcgtagagttggatcgtcggactgtagaactctgaac

SEQ ID NO: 9601 - DNA, 41 bp, Artificial sequence
  Synthetic
caggtctttctggcggatcgtcggactgtagaactctgaac

SEQ ID NO: 9602 - DNA, 41 bp, Artificial sequence
  Synthetic
caggtcggaatgtgtgatcgtcggactgtagaactctgaac

SEQ ID NO: 9603 - DNA, 41 bp, Artificial sequence
  Synthetic
caggtcctatggaaggatcgtcggactgtagaactctgaac

SEQ ID NO: 9604 - DNA, 41 bp, Artificial sequence
  Synthetic
caggtcaagtccatggatcgtcggactgtagaactctgaac

SEQ ID NO: 9605 - DNA, 41 bp, Artificial sequence
  Synthetic
caggtcagtacttgggatcgtcggactgtagaactctgaac

SEQ ID NO: 9606 - DNA, 41 bp, Artificial sequence
  Synthetic
caggtcacaggactagatcgtcggactgtagaactctgaac

SEQ ID NO: 9607 - DNA, 41 bp, Artificial sequence
  Synthetic
caggtcaccaggtaagatcgtcggactgtagaactctgaac

SEQ ID NO: 9608 - DNA, 41 bp, Artificial sequence
  Synthetic
caggtcgcatgaaccgatcgtcggactgtagaactctgaac

SEQ ID NO: 9609 - DNA, 41 bp, Artificial sequence
  Synthetic
caggtcgttggtgttgatcgtcggactgtagaactctgaac

SEQ ID NO: 9610 - DNA, 41 bp, Artificial sequence
  Synthetic
caggtcccttcagacgatcgtcggactgtagaactctgaac

SEQ ID NO: 9611 - DNA, 41 bp, Artificial sequence
  Synthetic
caggtccctcttggtgatcgtcggactgtagaactctgaac

SEQ ID NO: 9612 - DNA, 41 bp, Artificial sequence
  Synthetic
caggtcgggaaagttgatcgtcggactgtagaactctgaac

SEQ ID NO: 9613 - DNA, 41 bp, Artificial sequence
  Synthetic
caggtcagccagagtgatcgtcggactgtagaactctgaac

SEQ ID NO: 9614 - DNA, 41 bp, Artificial sequence
  Synthetic
caggtctcgcatctggatcgtcggactgtagaactctgaac

SEQ ID NO: 9615 - DNA, 41 bp, Artificial sequence
  Synthetic
caggtcgatacggcagatcgtcggactgtagaactctgaac

SEQ ID NO: 9616 - DNA, 41 bp, Artificial sequence
  Synthetic
caggtctcggccaaagatcgtcggactgtagaactctgaac

SEQ ID NO: 9617 - DNA, 41 bp, Artificial sequence
  Synthetic
caggtcagatttcgcgatcgtcggactgtagaactctgaac

SEQ ID NO: 9618 - DNA, 41 bp, Artificial sequence
  Synthetic
caggtcgaccctcaagatcgtcggactgtagaactctgaac

SEQ ID NO: 9619 - DNA, 41 bp, Artificial sequence
  Synthetic
caggtcagtccactcgatcgtcggactgtagaactctgaac

SEQ ID NO: 9620 - DNA, 41 bp, Artificial sequence
  Synthetic
caggtccaaacgatcgatcgtcggactgtagaactctgaac

SEQ ID NO: 9621 - DNA, 41 bp, Artificial sequence
  Synthetic
caggtcgcctaataggatcgtcggactgtagaactctgaac

SEQ ID NO: 9622 - DNA, 41 bp, Artificial sequence
  Synthetic
caggtcggctacatcgatcgtcggactgtagaactctgaac

SEQ ID NO: 9623 - DNA, 41 bp, Artificial sequence
  Synthetic
caggtctatgagcaggatcgtcggactgtagaactctgaac

SEQ ID NO: 9624 - DNA, 41 bp, Artificial sequence
  Synthetic
caggtcggtagtaacgatcgtcggactgtagaactctgaac

SEQ ID NO: 9625 - DNA, 41 bp, Artificial sequence
  Synthetic
caggtccgcgtatatgatcgtcggactgtagaactctgaac

SEQ ID NO: 9626 - DNA, 41 bp, Artificial sequence
  Synthetic
caggtctactggagcgatcgtcggactgtagaactctgaac

SEQ ID NO: 9627 - DNA, 41 bp, Artificial sequence
  Synthetic
caggtcagggaatcagatcgtcggactgtagaactctgaac

SEQ ID NO: 9628 - DNA, 41 bp, Artificial sequence
  Synthetic
caggtcatccgagatgatcgtcggactgtagaactctgaac

SEQ ID NO: 9629 - DNA, 41 bp, Artificial sequence
  Synthetic
caggtctcccaagcagatcgtcggactgtagaactctgaac

SEQ ID NO: 9630 - DNA, 41 bp, Artificial sequence
  Synthetic
caggtcgagccgtttgatcgtcggactgtagaactctgaac

SEQ ID NO: 9631 - DNA, 41 bp, Artificial sequence
  Synthetic
caggtctgctcttacgatcgtcggactgtagaactctgaac

SEQ ID NO: 9632 - DNA, 41 bp, Artificial sequence
  Synthetic
caggtcacgactaccgatcgtcggactgtagaactctgaac

SEQ ID NO: 9633 - DNA, 41 bp, Artificial sequence
  Synthetic
caggtccaagcagctgatcgtcggactgtagaactctgaac

SEQ ID NO: 9634 - DNA, 40 bp, Artificial sequence
  Synthetic
caggtcgtattcgcgatcgtcggactgtagaactctgaac

SEQ ID NO: 9635 - DNA, 40 bp, Artificial sequence
  Synthetic
caggtcgctctgaagatcgtcggactgtagaactctgaac

SEQ ID NO: 9636 - DNA, 40 bp, Artificial sequence
  Synthetic
caggtcacgtagtggatcgtcggactgtagaactctgaac

SEQ ID NO: 9637 - DNA, 40 bp, Artificial sequence
  Synthetic
caggtcattgggtcgatcgtcggactgtagaactctgaac

SEQ ID NO: 9638 - DNA, 40 bp, Artificial sequence
  Synthetic
caggtcaacagcacgatcgtcggactgtagaactctgaac

SEQ ID NO: 9639 - DNA, 40 bp, Artificial sequence
  Synthetic
caggtctcagagacgatcgtcggactgtagaactctgaac

SEQ ID NO: 9640 - DNA, 40 bp, Artificial sequence
  Synthetic
caggtcgtgtgctagatcgtcggactgtagaactctgaac

SEQ ID NO: 9641 - DNA, 40 bp, Artificial sequence
  Synthetic
caggtcgcagttgagatcgtcggactgtagaactctgaac

SEQ ID NO: 9642 - DNA, 40 bp, Artificial sequence
  Synthetic
caggtcttaacggggatcgtcggactgtagaactctgaac

SEQ ID NO: 9643 - DNA, 40 bp, Artificial sequence
  Synthetic
caggtcgctcgattgatcgtcggactgtagaactctgaac

SEQ ID NO: 9644 - DNA, 40 bp, Artificial sequence
  Synthetic
caggtcacacctgtgatcgtcggactgtagaactctgaac

SEQ ID NO: 9645 - DNA, 40 bp, Artificial sequence
  Synthetic
caggtcagacggttgatcgtcggactgtagaactctgaac

SEQ ID NO: 9646 - DNA, 40 bp, Artificial sequence
  Synthetic
caggtcgcaaaccagatcgtcggactgtagaactctgaac

SEQ ID NO: 9647 - DNA, 40 bp, Artificial sequence
  Synthetic
caggtcgagtatgggatcgtcggactgtagaactctgaac

SEQ ID NO: 9648 - DNA, 40 bp, Artificial sequence
  Synthetic
caggtcggtctttcgatcgtcggactgtagaactctgaac

SEQ ID NO: 9649 - DNA, 40 bp, Artificial sequence
  Synthetic
caggtccatctgctgatcgtcggactgtagaactctgaac

SEQ ID NO: 9650 - DNA, 40 bp, Artificial sequence
  Synthetic
caggtcttcgcaaggatcgtcggactgtagaactctgaac

SEQ ID NO: 9651 - DNA, 40 bp, Artificial sequence
  Synthetic
caggtcttgtgacggatcgtcggactgtagaactctgaac

SEQ ID NO: 9652 - DNA, 40 bp, Artificial sequence
  Synthetic
caggtctgcatgacgatcgtcggactgtagaactctgaac

SEQ ID NO: 9653 - DNA, 40 bp, Artificial sequence
  Synthetic
caggtccaacgtgagatcgtcggactgtagaactctgaac

SEQ ID NO: 9654 - DNA, 40 bp, Artificial sequence
  Synthetic
caggtctaggcttcgatcgtcggactgtagaactctgaac

SEQ ID NO: 9655 - DNA, 40 bp, Artificial sequence; identical to SEQ ID NO: 9556
  Synthetic

SEQ ID NO: 9656 - DNA, 40 bp, Artificial sequence
  Synthetic
caggtctgcagcttgatcgtcggactgtagaactctgaac

SEQ ID NO: 9657 - DNA, 40 bp, Artificial sequence
  Synthetic
caggtcctgtacctgatcgtcggactgtagaactctgaac

SEQ ID NO: 9658 - DNA, 40 bp, Artificial sequence
  Synthetic
caggtccgcaatgagatcgtcggactgtagaactctgaac

SEQ ID NO: 9659 - DNA, 40 bp, Artificial sequence
  Synthetic
caggtcgatccaaggatcgtcggactgtagaactctgaac

SEQ ID NO: 9660 - DNA, 40 bp, Artificial sequence
  Synthetic
caggtccacttacggatcgtcggactgtagaactctgaac

SEQ ID NO: 9661 - DNA, 40 bp, Artificial sequence
  Synthetic
caggtcaactaggcgatcgtcggactgtagaactctgaac

SEQ ID NO: 9662 - DNA, 40 bp, Artificial sequence
  Synthetic
caggtcactagcgtgatcgtcggactgtagaactctgaac

SEQ ID NO: 9663 - DNA, 40 bp, Artificial sequence
  Synthetic
caggtccgttcgttgatcgtcggactgtagaactctgaac

SEQ ID NO: 9664 - DNA, 40 bp, Artificial sequence
  Synthetic
caggtcagtcacgagatcgtcggactgtagaactctgaac

SEQ ID NO: 9665 - DNA, 40 bp, Artificial sequence
  Synthetic
caggtccctgtaacgatcgtcggactgtagaactctgaac

SEQ ID NO: 9666 - DNA, 40 bp, Artificial sequence
  Synthetic
caggtcgtcctcttgatcgtcggactgtagaactctgaac

SEQ ID NO: 9667 - DNA, 40 bp, Artificial sequence
  Synthetic
caggtccagcgaatgatcgtcggactgtagaactctgaac

SEQ ID NO: 9668 - DNA, 40 bp, Artificial sequence
  Synthetic
caggtcatggttgggatcgtcggactgtagaactctgaac

SEQ ID NO: 9669 - DNA, 40 bp, Artificial sequence
  Synthetic
caggtcgaggttctgatcgtcggactgtagaactctgaac

SEQ ID NO: 9670 - DNA, 40 bp, Artificial sequence
  Synthetic
caggtctacctcgagatcgtcggactgtagaactctgaac

SEQ ID NO: 9671 - DNA, 40 bp, Artificial sequence
  Synthetic
caggtcttctgtgcgatcgtcggactgtagaactctgaac

SEQ ID NO: 9672 - DNA, 40 bp, Artificial sequence
  Synthetic
caggtcgacaactggatcgtcggactgtagaactctgaac

SEQ ID NO: 9673 - DNA, 40 bp, Artificial sequence
  Synthetic
caggtccgacaacagatcgtcggactgtagaactctgaac

SEQ ID NO: 9674 - DNA, 40 bp, Artificial sequence
  Synthetic
caggtctcgataccgatcgtcggactgtagaactctgaac

SEQ ID NO: 9675 - DNA, 40 bp, Artificial sequence
  Synthetic
caggtcccatactcgatcgtcggactgtagaactctgaac

SEQ ID NO: 9676 - DNA, 40 bp, Artificial sequence
  Synthetic
caggtcattcgcaggatcgtcggactgtagaactctgaac

SEQ ID NO: 9677 - DNA, 40 bp, Artificial sequence
  Synthetic
caggtcaccatagggatcgtcggactgtagaactctgaac

SEQ ID NO: 9678 - DNA, 40 bp, Artificial sequence
  Synthetic
caggtccgatcaaggatcgtcggactgtagaactctgaac

SEQ ID NO: 9679 - DNA, 40 bp, Artificial sequence
  Synthetic
caggtcaccttgctgatcgtcggactgtagaactctgaac

SEQ ID NO: 9680 - DNA, 40 bp, Artificial sequence
  Synthetic
caggtcgactcagtgatcgtcggactgtagaactctgaac

SEQ ID NO: 9681 - DNA, 40 bp, Artificial sequence
  Synthetic
caggtcgtcaatccgatcgtcggactgtagaactctgaac

SEQ ID NO: 9682 - DNA, 68 bp, Artificial sequence; identical to SEQ ID NO: 9568
  Synthetic

SEQ ID NO: 9683 - DNA, 68 bp, Artificial sequence; identical to SEQ ID NO: 9569
  Synthetic

SEQ ID NO: 9684 - DNA, 68 bp, Artificial sequence; identical to SEQ ID NO: 9570
  Synthetic

SEQ ID NO: 9685 - DNA, 68 bp, Artificial sequence; identical to SEQ ID NO: 9571
  Synthetic

SEQ ID NO: 9686 - DNA, 68 bp, Artificial sequence; identical to SEQ ID NO: 9572
  Synthetic

SEQ ID NO: 9687 - DNA, 68 bp, Artificial sequence; identical to SEQ ID NO: 9573
  Synthetic

SEQ ID NO: 9688 - DNA, 68 bp, Artificial sequence; identical to SEQ ID NO: 9574
  Synthetic

SEQ ID NO: 9689 - DNA, 68 bp, Artificial sequence; identical to SEQ ID NO: 9575
  Synthetic

SEQ ID NO: 9690 - DNA, 68 bp, Artificial sequence; identical to SEQ ID NO: 9576
  Synthetic

SEQ ID NO: 9691 - DNA, 68 bp, Artificial sequence; identical to SEQ ID NO: 9577
  Synthetic

SEQ ID NO: 9692 - DNA, 66 bp, Artificial sequence
  Synthetic
aatgatacggcgaccaccgagatctacacgcctgtccgcggaagcagtggtatcaacgcagagtac

SEQ ID NO: 9693 - DNA, 37 bp, Artificial sequence
  Synthetic
gcctgtccgcggaagcagtggtatcaacgcagagtac

SEQ ID NO: 9694 - DNA, 30 bp, Artificial sequence
  Synthetic
  misc_feature (28)..(30): riboguanosine
aagcagtggtatcaacgcagagtgaatggg

SEQ ID NO: 9695 - DNA, 37 bp, Artificial sequence; identical to SEQ ID NO: 9693
  Synthetic

SEQ ID NO: 9696 - DNA, 68 bp, Artificial sequence
  Synthetic
  misc_feature (33)..(38): n is a, c, g, or t
tttttttaagcagtggtatcaacgcagagtacnnnnnntttttttttttttttttttttttttttttt

What is claimed is:

1. A method for demultiplexing capture bead barcodes using sequential fluorescence hybridization, wherein said method comprises:
   (a) introducing into a plurality of microwells at least one cell and one capture bead, wherein the microwells are formed from a first substrate that faces a second substrate, wherein the capture bead comprises a plurality of oligonucleotide sequences attached thereto, and wherein each oligonucleotide sequence comprises:
      i) a PCR handle identical in each oligonucleotide sequence on each capture bead,
      ii) a barcode configured for identification of the attached capture bead and an associated cell, wherein the barcode comprises N blocks, wherein each block is an oligonucleotide sequence of length 8 nt to 30 nt chosen from one of N unique sets of M oligonucleotide sequences, wherein N is at least 2 and M is at least 30, wherein said barcode is identifiable by sequential fluorescence hybridization;
      iii) a unique molecular identifier (UMI) of length 6 to 16 nucleotides (nt); and
      iv) an oligo(dT);
   (b) adding a lysis buffer to the microwells, capturing RNA from said at least one cell onto the capture bead, and reverse transcribing; and
   (c) optically demultiplexing the capture bead barcodes using sequential fluorescence hybridization, wherein the sequential fluorescence hybridization comprises sequentially introducing mixtures of fluorescently labeled oligonucleotide probes into the microwells, wherein:
      i) each of said probes is complementary to one of the oligonucleotide sequences in the unique sets of M oligonucleotide sequences,
      ii) said mixtures each comprise at least two probes which are complementary to oligonucleotides sequences within the same unique set of M oligonucleotide sequences, and
      iii) the fluorescent label for each of said at least two probes complementary to oligonucleotide sequences within the same unique set of M oligonucleotide sequences is a universal fluorescently labeled oligonucleotide hybridized to a universal sequence included in said probes,
   wherein a direct association is provided between phenotypic imaging information acquired from the single cells while located within the microwell and sequence data acquired from the captured and reverse transcribed cellular mRNA.

2. The method of claim 1, wherein said first and/or second substrates are polysiloxane substrates.

3. The method of claim 2, wherein the first and second substrates are polydimethylsiloxane (PDMS) substrates.

4. The method of claim 1, wherein N is 2 and M is 96.

5. The method of claim 1, wherein the UMI is of length 6 nt.

6. The method of claim 1, wherein N is 2 and M is 96 and the oligonucleotide sequences are set forth in SEQ ID NO: 248 through SEQ ID NO: 9463.

7. The method of claim 1, wherein said at least one cell is only one cell in each microwell.

8. The method of claim 7, further comprising, prior to step b), imaging said only one cell in each of said microwells to generate phenotypic imaging information.

9. The method of claim 8, wherein said reverse transcribing generates cDNA, and the method further comprises treating said cDNA to generate a sequencing library.

10. The method of claim 9, further comprising sequencing said sequencing library to generate sequence data.

11. The method of claim 10, wherein said optically demultiplexing the capture bead barcodes generates optical barcode data.

12. The method of claim 11, further comprising linking said sequence data to said phenotypic imaging information using said optical barcode data.

* * * * *